US007803769B2

(12) United States Patent
Sullivan et al.

(10) Patent No.: US 7,803,769 B2
(45) Date of Patent: Sep. 28, 2010

(54) OSK1 PEPTIDE ANALOGS AND PHARMACEUTICAL COMPOSITIONS

(75) Inventors: John K. Sullivan, Newbury Park, CA (US); Joseph G. McGivern, Oak Park, CA (US); Leslie P. Miranda, Thousand Oaks, CA (US)

(73) Assignee: Amgen Inc., Thousand Oaks, CA (US)

( * ) Notice: Subject to any disclaimer, the term of this patent is extended or adjusted under 35 U.S.C. 154(b) by 126 days.

(21) Appl. No.: 11/978,110

(22) Filed: Oct. 25, 2007

(65) Prior Publication Data

US 2009/0281028 A1 Nov. 12, 2009

Related U.S. Application Data

(60) Provisional application No. 60/854,674, filed on Oct. 25, 2006, provisional application No. 60/995,370, filed on Sep. 25, 2007.

(51) Int. Cl.
*A61K 38/16* (2006.01)
*A61K 35/56* (2006.01)
*C07K 14/00* (2006.01)

(52) U.S. Cl. .......................... 514/12; 530/324; 424/538

(58) Field of Classification Search ....................... None
See application file for complete search history.

(56) References Cited

U.S. PATENT DOCUMENTS

| | | | | |
|---|---|---|---|---|
| 3,691,016 | A | 9/1972 | Patel | |
| 3,941,763 | A | 3/1976 | Sarantakis | |
| 3,969,287 | A | 7/1976 | Jaworek et al. | |
| 4,083,368 | A | 4/1978 | Freezer | |
| 4,195,128 | A | 3/1980 | Hildebrand et al. | |
| 4,229,537 | A | 10/1980 | Hodgins et al. | |
| 4,247,642 | A | 1/1981 | Hirohara et al. | |
| 4,330,440 | A | 5/1982 | Ayers et al. | |
| 4,351,337 | A | 9/1982 | Sidman | |
| 4,686,283 | A * | 8/1987 | Nestor et al. | 530/327 |
| 4,847,325 | A | 7/1989 | Shadle et al. | |
| 4,849,224 | A | 7/1989 | Chang et al. | |
| 4,906,159 | A | 3/1990 | Sabo et al. | |
| 4,906,169 | A | 3/1990 | Chien et al. | |
| 4,911,916 | A | 3/1990 | Cleary | |
| 4,925,673 | A | 5/1990 | Steiner et al. | |
| 4,925,677 | A | 5/1990 | Feijen | |
| 4,983,395 | A | 1/1991 | Chang et al. | |
| 4,994,439 | A | 2/1991 | Longenecker et al. | |
| 5,013,556 | A | 5/1991 | Woodle et al. | |
| 5,023,084 | A | 6/1991 | Chien et al. | |
| 5,166,322 | A | 11/1992 | Shaw et al. | |
| 5,171,264 | A | 12/1992 | Merrill | |
| 5,206,344 | A | 4/1993 | Katre et al. | |
| 5,252,714 | A | 10/1993 | Harris et al. | |
| 5,284,656 | A | 2/1994 | Platz et al. | |
| 5,302,697 | A | 4/1994 | Goodey et al. | |
| 5,346,701 | A | 9/1994 | Heiber et al. | |
| 5,397,702 | A | 3/1995 | Cahalan et al. | |
| 5,446,090 | A | 8/1995 | Harris | |
| 5,460,820 | A | 10/1995 | Ebert et al. | |
| 5,484,895 | A | 1/1996 | Meister et al. | |
| 5,494,895 | A | 2/1996 | Garcia et al. | |
| 5,516,523 | A | 5/1996 | Heiber et al. | |
| 5,605,702 | A | 2/1997 | Teillaud et al. | |
| 5,643,575 | A | 7/1997 | Martinez et al. | |
| 5,662,925 | A | 9/1997 | Ebert et al. | |
| 5,714,142 | A | 2/1998 | Blaney et al. | |
| 5,739,208 | A | 4/1998 | Harris | |
| 5,739,277 | A | 4/1998 | Presta et al. | |
| 5,763,478 | A | 6/1998 | Baker et al. | |
| 5,783,208 | A | 7/1998 | Venkateshwaran et al. | |
| 5,792,451 | A | 8/1998 | Sarubbi et al. | |
| 5,827,655 | A | 10/1998 | Chandy et al. | |
| 5,900,461 | A | 5/1999 | Harris | |
| 5,919,455 | A | 7/1999 | Greenwald et al. | |
| 5,932,462 | A | 8/1999 | Harris et al. | |
| 5,990,237 | A | 11/1999 | Bentley et al. | |
| 6,022,952 | A | 2/2000 | Weiner et al. | |
| 6,077,680 | A | 6/2000 | Kem et al. | |
| 6,096,891 | A | 8/2000 | Carr et al. | |

(Continued)

FOREIGN PATENT DOCUMENTS

EP 0 219 716 A2 4/1987

(Continued)

OTHER PUBLICATIONS

Bowie et al. Deciphering the message in protein sequences: tolerance to amino acid substitutions. Science, (Mar. 16, 1990) 247 (4948) 1306-10.*

(Continued)

*Primary Examiner*—David S Romeo
(74) *Attorney, Agent, or Firm*—Nisan A. Steinberg

(57) ABSTRACT

Disclosed is a composition of matter comprising an OSK1 peptide analog, and in some embodiments, a pharmaceutically acceptable salt thereof. A pharmaceutical composition comprises the composition and a pharmaceutically acceptable carrier. Also disclosed are DNAs encoding the inventive composition of matter, an expression vector comprising the DNA, and host cells comprising the expression vector. Methods of treating an autoimmune disorder and of preventing or mitigating a relapse of a symptom of multiple sclerosis are also disclosed.

3 Claims, 128 Drawing Sheets

U.S. PATENT DOCUMENTS

| | | | |
|---|---|---|---|
| 6,245,740 | B1 | 6/2001 | Goldenberg et al. |
| 6,267,964 | B1 | 7/2001 | Nygren et al. |
| 6,273,086 | B1 | 8/2001 | Ohki et al. |
| 6,335,178 | B1 | 1/2002 | Weiner et al. |
| 6,342,225 | B1 | 1/2002 | Jones et al. |
| 6,451,986 | B1 | 9/2002 | Pettit |
| 6,548,644 | B1 | 4/2003 | Pettit |
| 6,551,821 | B1 | 4/2003 | Kandel et al. |
| 6,552,170 | B1 | 4/2003 | Thompson et al. |
| 6,602,498 | B2 | 8/2003 | Shen |
| 6,610,281 | B2 | 8/2003 | Harris |
| 6,632,928 | B1 | 10/2003 | Neville et al. |
| 6,660,843 | B1 | 12/2003 | Feige et al. |
| 6,689,749 | B1 | 2/2004 | Lebrun et al. |
| 6,703,485 | B2 | 3/2004 | Kandel et al. |
| 6,740,743 | B2 | 5/2004 | Herrmann et al. |
| 6,768,002 | B1 | 7/2004 | Herrmann et al. |
| 6,818,418 | B1 | 11/2004 | Lipovsek et al. |
| 6,849,714 | B1 | 2/2005 | Bridon et al. |
| 6,861,405 | B2 | 3/2005 | Desir et al. |
| 6,887,470 | B1 | 5/2005 | Bridon et al. |
| 6,892,728 | B2 | 5/2005 | Helgesson et al. |
| 6,894,025 | B2 | 5/2005 | Harris |
| 6,900,317 | B2 | 5/2005 | Trunk et al. |
| 6,905,688 | B2 | 6/2005 | Rosen et al. |
| 6,926,898 | B2 | 8/2005 | Rosen et al. |
| 6,932,962 | B1 | 8/2005 | Bäckström et al. |
| 6,946,134 | B1 | 9/2005 | Rosen et al. |
| 6,989,365 | B2 | 1/2006 | Fleer et al. |
| 7,005,436 | B2 | 2/2006 | Lloyd et al. |
| 7,029,909 | B1 | 4/2006 | Uemura et al. |
| 7,096,942 | B1 | 8/2006 | de Rouffignac et al. |
| 7,288,254 | B2 | 10/2007 | Neville et al. |
| 7,348,004 | B2 | 3/2008 | Peters et al. |
| 7,381,408 | B2 | 6/2008 | Mezo et al. |
| 7,404,956 | B2 | 7/2008 | Peters et al. |
| 2003/0069170 | A1 | 4/2003 | Soltero et al. |
| 2003/0069395 | A1 | 4/2003 | Sato et al. |
| 2003/0104400 | A1 | 6/2003 | Ruben et al. |
| 2003/0191056 | A1 | 10/2003 | Walker et al. |
| 2003/0195154 | A1 | 10/2003 | Walker et al. |
| 2004/0039167 | A1 | 2/2004 | Sabatier et al. |
| 2004/0044188 | A1 | 3/2004 | Feige et al. |
| 2004/0121959 | A1 | 6/2004 | Boone et al. |
| 2005/0054051 | A1 | 3/2005 | Rosen et al. |
| 2005/0054570 | A1 | 3/2005 | Rosen et al. |
| 2007/0071764 | A1 | 3/2007 | Sullivan et al. |
| 2007/0105199 | A1 | 5/2007 | Yan et al. |

FOREIGN PATENT DOCUMENTS

| | | | |
|---|---|---|---|
| EP | 0 315 456 | B1 | 6/1994 |
| EP | 0 668 353 | A1 | 8/1995 |
| EP | 0 668 354 | A1 | 8/1995 |
| EP | 0 473 084 | B1 | 11/1995 |
| EP | 0 469 074 | B1 | 7/1996 |
| EP | 0 575 545 | B1 | 5/2003 |
| WO | WO 88/06451 | A1 | 9/1988 |
| WO | WO 92/02634 | A1 | 2/1992 |
| WO | WO 95/03065 | A1 | 2/1995 |
| WO | WO 95/13312 | A1 | 5/1995 |
| WO | WO 96/05309 | A2 | 2/1996 |
| WO | WO 96/05309 | A3 | 2/1996 |
| WO | WO 96/11953 | A1 | 4/1996 |
| WO | WO 96/32478 | A1 | 10/1996 |
| WO | WO 97/34631 | A1 | 9/1997 |
| WO | WO 98/23639 | A2 | 6/1998 |
| WO | WO 98/39363 | A2 | 9/1998 |
| WO | WO 99/24055 | A1 | 5/1999 |
| WO | WO 99/38008 | A1 | 7/1999 |
| WO | WO 00/38651 | A1 | 7/2000 |
| WO | WO 00/38652 | A1 | 7/2000 |
| WO | WO 00/69900 | A2 | 11/2000 |
| WO | WO 01/83525 | A2 | 11/2001 |
| WO | WO 02/11801 | A1 | 2/2002 |
| WO | WO 02/098446 | A1 | 12/2002 |
| WO | WO 02/100248 | A2 | 12/2002 |
| WO | WO 2004/017918 | A2 | 3/2004 |
| WO | WO 2004/026329 | A1 | 4/2004 |
| WO | WO 2004/043396 | A2 | 5/2004 |
| WO | WO 2004/110472 | A2 | 12/2004 |
| WO | WO 2005/047337 | A1 | 5/2005 |
| WO | WO 2006/002850 | A2 | 1/2006 |
| WO | WO 2006/036834 | A2 | 4/2006 |
| WO | WO 2006/042151 | A2 | 4/2006 |
| WO | WO 2006/116156 | A2 | 11/2006 |
| WO | WO 2007/022070 | A2 | 2/2007 |
| WO | 2007048037 | A2 | 4/2007 |
| WO | WO 2007/045463 | A1 | 4/2007 |

OTHER PUBLICATIONS

Ngo et al., in the Protein Folding Problem and Tertiary Structure Prediction, Merz and Le Grand (Eds), Aug. 1994, Springer Verlag, pp. 433 and 492-495.*

Abdul, et al., "Activity of Potassium Channel-blockers in Breast Cancer", *Anticancer Research*, 23: 3347-3352 (2003).

Abuchowski, et al., "Soluble Polymer-Enzyme Adducts", *Enzymes as Drugs*, pp. 362-383 (1981).

Adams, et al., "Conotoxins and their Potential Pharmaceutical Applications", *Drug Devel. Research*, 46: 219-234 (1999).

Adjei, et al., Pulmonary Delivery of Peptide Drugs: Effect of Particle Size on Bioavailability of Leuprolide Acetate in Healthy Male Volunteers, *Pharma. Res*., 7: 565-569 (1990).

Adjei, et al., "Bioavailability of Leuprolide Following Intratracheal Administration to Beagle Dogs", *Internatl. J Pharmaceutics*, 61: 135-144 (1990).

"Advanced Chemtech Handbook of Combinatorial and Solid Phase Organic Chemistry", Bennett, W.D. (ed.), Advanced Chem Tech, Inc., Louisville, Kentucky, (1998) (Provided Table of Contents only).

Alberts, et al., "Synthesis of a Novel Hematopoietic Peptide SK&F 107647", *Thirteenth Am. Pep. Symp*., pp. 367-369 (1993).

Altschul, et al, "Gapped BLAST and PSI-BLAST: A New Generation of Protein Database Search Programs", *Nuc. Acids Res*., 25: 3389-3402 (1997).

Azam, et al., "Targeting Effector Memory T Cells with the Small Molecule Kv1.3 Blocker PAP-1 Suppresses Allergic Contact Dermatitis", *J Invest. Derm*., 127: 1419-1429 (2007).

Barrett, A., et al., (ed.), "Handbook of Proteolytic Enzymes", *Academic Press*, (1998) (Provided Table of Contents only).

Baumgart, et al., "Tacrolimus is Safe and Effective in Patients with Severe Steroid-Refractory or Steroid-Dependent Inflammatory Bowel Disease—A Long-Term Follow-Up", *Amer. J of Gastroenterology*, 101: 1048-1056 (2006).

Beeton, et al., "Kv1.3 Channels are a Therapeutic Target for T Cell-Mediated Autoimmune Diseases", *PNAS*, 103(46): 17414-17419 (2006).

Beeton, et al., "Targeting Effector Memory T Cells with a Selective Peptide Inhibitor of Kv1.3 Channels for Therapy of Autoimmune Diseases", *Mol. Pharmacol*., 67(4): 1369-1381 (2005).

Beeton, et al., "Selective Blockade of T Lymphocyte K+ Channels Ameliorates Experimental Autoimmune Encephalomyelitis, a Model for Multiple Sclerosis", *PNAS*, 98(24): 13942-13947 (2001).

Beeton, et al., "Selective Blocking of Voltage-Gated K+ Channels Improves Experimental Autoimmune Encephalomyelitis and Inhibits T Cell Activations", *J of Immunology*, 166: 936-944 (2001).

Begenisich, et al., "Physiological Roles of the Intermediate Conductance, $Ca^{2+}$-activated Potassium Channel Kcnn4", *J of Biological Chem*., 279(46): 47681-47687 (2004).

Berridge, et al., "Calcium Signalling: Dynamics, Homeostasis and Remodelling", *Nature Reviews Mol. Cell Biol*., 4: 517-529 (2003).

Bhatnagar, et al., "Structure-Activity Relationships of Novel Hematoregulatory Pepticides", *J Med. Chem*., 39: 3814-3819 (1996).

Bissonnette, et al., "A Randomized, Multicenter, Double-Blind, Placebo-Controlled Phase 2 Trial of ISA247 in Patients with Chronic Plaque Psoriasis", *J Am. Acad. Dermatol.*, 54: 472-478 (2006).
Bodanszky, et al., "The Practice of Peptide Synthesis", $2^{nd}$ Revised Ed., Springer-Verlag (1994) (Provided Table of Contents only).
Bodanszky, "Principles of Peptide Synthesis", $2^{nd}$ Ed., Springer Laboratory (1993) (Provided Table of Contents only).
Boehm, et al., "Cellular Response to Interferon-γ", *Annu. Rev. Immunul.*, 15: 749-795 (1997).
Bong, et al., "Chemoselective Pd(0)-Catalyzed Peptide Coupling in Water", *Org. Lett.*, 3(16): 2509-2511 (2001).
Bourinet, et al., "Silencing of the $Ca_v3.2$ T-type Calcium Channel Gene in Sensory Neurons Demonstrates its Major Role in Nociception", *EMBO J*, 24(2): 315-324 (2005).
Bowlby, et al., "Modulation of the Kv1.3 Potassium Channel by Receptor Tyrosine Kinases", *J Gen. Physiol.*, 110: 601-610 (1997).
Braquet, et al., "Effect of Endothelin-1 on Blood Pressure and Bronchopulmonary System of the Guinea Pig", *J of Cardiovascular Pharmacol.*, 13(Suppl. 5): S143-S146 (1989).
Caliceti, et al., "Pharmacokinetic and Biodistribution Properties of Poly(ethylene glycol)-Protein Conjugates", *Advanced Drug Delivery Reviews*, 55: 1261-1277 (2003).
Castle, et al., "Maurotoxin: A Potent Inhibitor of Intermediate Conductance $Ca^{2+}$-Activated Potassium Channels", *Mol. Pharmacol.*, 63(2): 409-418 (2003).
Catterall, et al., "International Union of Pharmacology: Approaches to the Nomenclature of Voltage-Gated Ion Channels", *Pharmacol. Rev.*, 55(4): 573-574 (2003).
Catterall, et al., "International Union of Pharmacology. XXXIX. Compendium of Voltage-Gated Ion Channels: Sodium Channels", *Pharmacol. Rev.*, 55(4): 575-578 (2003).
Catterall, et al., "International Union of Pharmacology, XL. Compendium of Voltage-Gated Ion Channels: Calcium Channels", *Pharmacol. Rev.*, 55(4): 579-581 (2003).
Chan, W. C. and White, P. D., Eds., "Fmoc Solid Phase Peptide Synthesis: A Practical Approach", *Oxford University Press*, (2000) (Provided Table of Contents only).
Chandy, et al., "$K^+$ Channels as Targets for Specific Immunomodulation", *Trends in Pharmacol. Sciences*, 25(5): 280-289 (2004).
Chandy, "Simplified Gene Nomenclature", *Nature*, 352: pp. 26 (1991).
Chen, et al., "MMDB: Entrez's 3D-Structure Database", *Nucleic Acids Res.*, 31(1), 474-477 (2003).
Clapham, et al., "International Union of Pharmacology. XLIII. Compendium of Voltage-Gated Ion Channels: Transient Receptor Potential Channels", *Pharmacol. Rev.*, 55(4): 591-596 (2003).
Connelly et al., "Neutral Endopeptidase 24.11 in Human Neutrophils: Cleavage of Chemotactic Peptide", *Proc. Natl. Acad. Sci. USA*, 82: 8737-8741 (1985).
Creighton, "Proteins: Structures and Molecular Principles", W. H. Freeman & Co., San Francisco, pp. 70-86 (1983).
Davis, et al., "Preparation and Characterization of Antibodies with Specificity for the Amino-Terminal Tetrapeptide Sequence of the Platelet-Derived Connective Tissue", *Biochem Intl.*, 10(3): 395-404 (1985).
Debs, et al., "Lung-Specific Delivery of Cytokines Induces Sustained Pulmonary and Systemic Immunomodulation in Rats", *J Immunol.*, 140: 3482-3488 (1988).
Dedman, et al., Selection of Targeted Biological Modifiers from a Bacteriophage Library of Random Peptides', *J Biol. Chem.*, 268(31): 23025-23030 (1993).
del Rio-Portilla, et al., "NMR Solution Structure of Cn12, a Novel Peptide from the Mexican Scorpion *Centruroides noxius* with a Typical β-Toxin Sequence but with α-Like Physiological Activity", *Eur. J Biochem.*, 271: 2504-2516 (2004).
Delgado, et al., "The Uses and Properties of PEG-Linked Proteins", *Critical Ref. in Thera. Drug Carrier Sys.*, 9(3,4): 249-304 (1992).
DeVasher, et al., "Aqueous-Phase, Palladium-Catalyzed Cross-Coupling of Aryl Bromides Under Mild Conditions, Using Water-Soluble, Sterically Demanding Alkylphosphines", *J Org. Chem.*, 69: 7919-7927 (2004).
Dibowski, et al., "Bioconjunction of Peptides by Palladium Catalyzed C-C Cross-Coupling in Water", *Angew. Chem. Int. Ed.*, 37(4): 476-478 (1998).
Dogrul, et al., "Reversal of Experimental Neuropathic Pain by T-Type Calcium Channel Blockers", *Pain*, 105: 159-168 (2003).
Duffy, et al., The $K^+$ Channel $iK_{CA}1$ Potentiates $Ca^{2+}$ Influx and Degranulation in Human Lung Mast Cells; *J Allergy Clin. Immunol.*, 114(1): 66-72 (2004).
Earnshaw; et al., "Mammalian Caspases: Structure, Activation, Substrates, and Functions During Apoptosis", *Annu. Rev. Biochem.*, 68: 383-424 (1999).
Ellison, et al., "The Nucleotide Sequence of a Human Immunoglobulin $C\gamma_1$Gene", *Nucleic Acids Res.*, 10(13): 4071-4079 (1982).
Engel, et al., "Insertion of Carrier Proteins into Hydrophilic Loops of the *Escherichia coli* Lactose Permease", *Biochimica et Biophysica Acta*, 1564: 38-46 (2002).
Erickson, et al., "Solid-Phase Peptide Synthesis", *The Proteins*, ($3^{rd}$ ed.), Chapter 3: 257-517 (1976).
Ertel, et al., "Nomenclature of Voltage-Gated Calcium Channels", *Neuron* 25: 533-535 (2000).
Felix, A.M., "Pegylated Peptides IV: Enhanced Biological Activity of Site-Directed Pegylated GRF Analogs", *Int. J Peptide Protein Res.* 46: 253-264 (1995).
Felix, A.M., "Site-Specific Poly(ethylene glycol)ylation of Peptides", *American Chem. Soc.*, Chapter 16, pp. 218-238 (1997).
Feske, et al., "A Severe Defect in CRAC $Ca^{2+}$ Channel Activation and altered $K^+$ Channel Gating in T Cells from Immunodeficient Patients", *J Exp. Med.* 202(5): 651-662 (2005).
Fields, et al., "Principles and Practice of Solid-Phase Peptide Synthesis", *Synthetic Peptides: A User's Guide*, Chapter 3, pp. 77-129, [G. Grant, ed., Oxford University Press] (1992).
Fields, et al., "Synthetic Peptides: A User's Guide", *Oxford University Press*, Grant, G.A. (ed.), ($2^{nd}$ ed.), Chapter 3, pp. 93-218 (2002).
Finn, et al., *The Proteins*, "The Synthesis of Peptides by Solution Methods with Emphasis on Peptide Hormones", ($3^{rd}$ ed.), vol. II, pp. 105-253 (1976).
Flatters, et al., "Ethosuximide Reverses Paclitaxel- and Vincristine-Induced Painful Peripheral Neuropathy", *Pain*, 109: 150-161 (2004).
Fraser, et al., "Predominant Expression of Kv1.3 Voltage-Gated $K^+$ Channel Subunit in Rat Prostate Cancer Cell Lines: Electrophysiological, Pharmacological and Molecular Characterisation", *Eur. J Physiol.*, 446: 559-571 (2003).
Gaffen, et al., "Overview of Interleukin-2 Function, Production and Clinical Applications", *Cytokine*, 28; 109-123 (2004).
Gennaro, A. R., *Remington's Pharmaceutical Sciences*, $18^{th}$ Ed., Mack Publishing Co., Easton, PA, (1990) (Provided Table of Contents only).
Glazebrook, et al., "Potassium Channels Kv1.1, Kv1.2 and Kv1.6 Influence Excitablity of Rat Visceral Sensory Neurons", *J Physiology* 541.2: 467-482 (2002).
Goldin, et al, "Nomenclature of Voltage-Gated Sodium Channels", *Neuron*, 28: 365-368 (2000).
González-Pinto, et al., "Five-Year Follow-Up of a Trial Comparing Tacrolimus and Cyclosporine Microemulsion in Liver Transplanation", *Transplan. Proc.*, 37: 1713-1715 (2005).
Goodson, "Site-Directed Pegylation of Recombinant Interleukin-2 at its Glycosylation Site", *Biotechnology*, 8: 343-346 (1990).
Greene, et al., *Protective Groups in Organic Synthesis*, $3^{rd}$. Ed., John Wiley & Sons, Inc., (1999) (Provided Table of Contents only).
Greenwald, et al., "Poly(ethylene glycol) Conjugated Drugs and Prodrugs: A Comprehensive Review", *Crit. Rev. in Therap. Drug Carrier Systems*, 17(2): 101-161 (2000).
Grgic, et al., "Selective Blockade of the Intermediate-Conductance $Ca^{2+}$ -Activated $K^+$ Channel Suppresses Proliferation of Microvascular and Macrovascular Endothelial Cells and Angiogenesis In Vivo", *Arterioscler Thromb. Vasc. Biol.*, 25: 704-709 (2005).
Gutman, et al., "International Union of Pharmacology. XLI. Compendium of Voltage-Gated Ion Channels: Potassium Channels", *Pharmacol. Rev.*, 55(4): 583-586 (2003).

Halaby, et al., "The Immunoglobin Fold Family: Sequence Analysis and 3D Structure Comparisons", *Prot. Engin.*, 12(7): 563-571 (1999).
Harte, et al., "Genome-Wide Detection and Family Clustering of Ion Channels", *FEBS Letters*, 514 129-134 (2002).
Hendrickson, et al., "Incorporation of Nonnatural Amino Acids into Proteins", *Annu. Rev. Biochem.*, 73: 147-176 (2004).
Herman, et al., Poly(Ethylene Glycol) with Reactive Endgroups: I. Modification of Proteins, *J. Bioactive and Comp. Polymers*, 10(2): 145-187 (1995).
Herz, et al., "Molecular Aproaches to Receptors as Targets for Drug Discovery", *J of Receptor & Signal Transduction Research*, 17(5): 671-776 (1997).
Hofmann, et al., "International Union of Pharmacology. XLII. Compendium of Voltage-Gated Ion Channels: Cyclic Nucleotide-Modulated Channels", *Pharmacol. Rev.*, 55(4): 587-589 (2003).
Hubbard, et al., "Anti-Neutrophil-Elastase Defenses of the Lower Respiratory Tract in α1-Antitrypsin Deficiency Directly Augmented with an Aerosol of α1-Antitrypsin", *Annals of Internal Med.*, 111(3): 206-212 (1989).
Jäger, et al., "Blockage of Intermediate-Conductance $Ca^{2+}$ -Activated $K^+$ Channels Inhibit Human Pancreatic Cancer Cell Growth in Vitro", *Mol. Pharmacol.*, 65(3): 630-638 (2004).
Jaravine, et al., "Three-Dimensional Structure of Toxin OSK1 from *Orthochirus scrobiculosus* Scorpion Venom", *Biochemistry*, 36: 1223-1232 (1997).
Jensen, et al., "The $Ca^{2+}$ -Activated K+ Channel of Intermediate Conductance: A Molecular Target for Novel Treatments?" *Current Drug Targets*, 2: 401-422 (2001).
Kalman, et al., "ShK-$Dap^{22}$, a Potent Kv1.3-Specific Immunosuppressive Polypeptide", *J Biol. Chem.*, 273(49): 32697-32707 (1998).
Kay, et al., "From Peptides to Drugs Via Phage Display", *Drug Disc. Today*, 3(8): 370-378 (1998).
Keil, B., *Specificity of Proteolysis*, Springer-Verlag, (Berlin/Heidelberg/New York) (1992) (Provided Table of Contents only).
Kho, et al., "A Tagging-Via-Substrate Technology for Detection and Proteomics of Farnesylated Proteins", *PNAS*, 101(34): 12479-12484 (2004).
Kocienski, P.J., "Protecting Groups", *Georg Thieme Verlag*, (Stuttgart/New York) (1994) (Provided Table of Contents only).
Köhler, et al., "Blockade of the Intermediate-Conductance Calcium-Activated Potassium Channel as a New Therapeutic Strategy for Restenosis", *Circulation*, 108: 1119-1125 (2003).
Koo, et al., "Blockade of the Voltage-Gated Potassium Channel Kvl.3 Inhibits Immune Responses in Vivo", *J Immunol.*, 158: 5120-5128 (1997).
Koo, J., "A Randomized, Double-Blind Study Comparing the Efficacy, Safety and Optional Dose of Two Formulations of Cyclosporin, Neoral and Sandimmun, in Patients with Severe Psoriasis", *British J Derm.*, 139: 88-95 (1998).
Krysan, et al., "Quantitative Characterization of Furin Specificity", *J of Biol. Chem.*, 274(33): 23229-23234 (1999).
Kuai, et al., "Plasminogen Activator Inhibitor-1 Fused with Erythropoietin (EPO) Mimetic Peptide (EMP) Enhances the EPO Activity of EMP", *J Peptide Res.*, 56: 59-62 (2000).
Kuypers, D.R. J., "Immunosuppressive Drug Monitoring—What to Use in Clinical Practice Today to Improve Renal Graft Outcome", *Transplant Internat.*, 18: 140-150 (2005).
Kyte, et al., "A Simple Method for Displaying the Hydropathic Character of a Protein", *J Mol. Biol.*, 157: 105-132 (1982).
Lehmann-Horn, et al., "Voltage-Gated Ion Channels and Hereditary Disease", *Physiol. Reviews*, 79(4): 1317-1372 (1999).
Lewis, et al., "Therapeutic Potential of Venom Peptides", *Nature Reviews/Drug Dis.*, 2: 790-802 (2003).
Link, et al., "Non-Canonical Amino Acids in Protein Engineering", *Curr. Opn. in Biotech.*, 14: 609-609 (2003).
Lu, et al., "Pegylated Peptides, III. Solid-Phase Synthesis with Pegylating Reagents of Varying Molecular Weight: Synthesis of Multiply Pegylated Peptides", *Reactive Polymers*, 22: 221-229 (1994).
MacLennan, et al., "Structure-Function Relationships in the $Ca^{2+}$-Binding and Translocation Domain of SERCA1: Physiological Correlates in Brody Disease", *Acta. Physiol. Scand.*, 163(Suppl 643) 55-67 (1998).
Macian, F., "NFAT Proteins: Key Regulators of T-Cell Development and Function", *Nature/Reviews/Immunol.*, 5: 472-484 (2005).
Maniatis, et al., "Regulation of Inducible and Tissue-Specific Gene Expression", *Science*, 236: 1237-1245 (1987).
Marshall, K., "Solid Oral Dosage Forms", *Modern Pharmaceutics*, Chapter 10: 359-427 (1979).
Mauler, et al., "Selective Intermediate-/Small-Conductance Calcium-Activated Potassium Channel (KCNN4) Blockers are Potent and Effective Therapeutics in Experimental Brain Oedema and Traumatic Brain Injury Caused by Acute Subdural Haematoma", *European J Neuroscience*, 20: 1761-1768 (2004).
Means, et al., "Chemical Modification of Proteins / Selected Techniques for the Modification of Protein Side Chains", *Holden Day, Inc.*, 214-230 (1971).
Merrifield, R.B., "Solid-Phase Peptide Synthesis. I. The Synthesis of a Tetrapeptide", *J Am. Chem. Soc.*, 85: 2149-2154 (1963).
Merrifield, R.B., "Solid-Phase Peptide Synthesis", *Chem. Polypeptides*, Chapter 16, pp. 335-361 (1973).
Morpurgo, et al., "Preparation and Characterization of Poly(ethylene glycol) Vinyl Sulfone", *Bioconjugate Chem.*, 7: 363-368 (1996).
Mouhat et al., "K+ Channel Types Targeted by Synthetic OSK1, a Toxin from *Orthochirus scrobiculosus* Scorpion Venom", *Biochem J*, 385: 95-104 (2005).
Mouhat, et al., "Phqarmacological Profiling of *Orthochirus scrobiculosus* Toxin 1 Analogs with a Trimmed N-Terminal Domain", *Mol. Pharmacol.*, 69(1): 354-362 (2006).
Mouhat, et al., "Pharmacological Profiling of *Orthochirus scrobiculosus* toxin 1 analogues with a trimmed N-terminal domain", *Mol. Pharmacol. Fast Forward*, [doi:10.1124/mol.105.017210], pp. 1-30 (2005).
Multiple Sclerosis Study Group, "Efficacy and Toxicity of Cyclosporine in Chronic Progressive Multiple Sclerosis: A Randomized, Double-blinded, Placebo-Controlled Clinical Trial", *Annals Neurol.*, 27(6): 591-605 (1990).
Nelson, et al, "The Endogenous Redox Agent Ĺ-Cysteine Induces T-Type $Ca^{2+}$ Channel-Dependent Sensitization of a Novel Subpopulation of Rat Peripheral Nociceptors", *J of Neurosci.*, 25(38): 8766-8775 (2005).
Newmark, et al., "Preparation and Properites of Adducts of Streptokinase and Streptokinase-Plasmin Complex with Polyethylene Glycol and Pluronic Polyol F38", *J Appl. Biochem.*, 4: 185-189 (1982).
Nicke, et al., "α-Conotoxins as Tools for the Elucidation of Structure and Function of Neuronal Nicotinic Acetylcholine Receptor Subtypes", *Eur J Biochem.*, 271: 2305-2319 (2004).
Niemeyer, et al., "Ion Channels in Health and Disease", *EMBO Reports*, 2(7): 568-573 (2001).
"Nomenclature and Symbolism for Amino Acids and Peptides, Recommendations 1983", *FEBS 1984, Eur. J Biochem*, 138: 9-37 (1984).
"Nomenclature and Symbolism for amino acids and peptides, Enzyme Nomenclature 1984 Announcement, Corrections to Recommendations 1983", *FEBS 1985, Eur. J. Biochem*, 152: 1 (1985).
"Nomenclature and Symbolism for amino acids and peptides, Biochemical nomenclature, and Enzyme nomenclature Announcements: Symbolism and terminology in enzyme kinetics, Correction to Recommendations 1981, Nomenclature and symbolism for amino acids and peptides, Corrections to Recommendations 1983, The nomenclature of steroids, Corrections to Recommendations 1989, Nomenclature of electron-transfer proteins, Corrections to Recommendations 1989", *FEBS 1993, Eur. J. Biochem.*, 213: 1-3 (1993).
Norton, et al., "Potassium Channel Blockade by the Sea Anemone Toxin ShK for the Treatment of Multiple Sclerosis and Other Autoimmune Diseases", *Curr. Med. Chem.*, 11: 3041-3052 (2004).
Nova Biochem, "Channel Blockers", Calbiochem, 10294 Pacific Ctr. Ct., San Diego, CA 92121.
Oeswein, et al., "Aerosolization of Protein Pharmaceuticals", Proc. Symp. Resp. Drug Delivery II, Keystone, CO, (1990).
Pathirathna, et al., "New Evidence That Both T-Type Calcium Channels and $GABA_A$ Channels are Responsible for the Potent Peripheral Analgesic Effects of 5α-Reduced Neuroactive Steroids", *Pain*, 114: 429-443 (2005).

Pennington, et al., "Role of Disulfide Bonds in the Structure and Potassium Channel Blocking Activity of ShK Toxin", *Biochem.*, 38: 14549-14558 (1999).

Prescher, et al., "Chemistry in Living Systems", *Nat. Chem. Biol.*, 1(1): 13-21 (2005).

Prochnicka-Chalufour, "Solution of Discrepin, a New K+-Channel Blocking Peptide from the α-KTx15 Subfamily", *Biochemistry*, 45: 1795-1804 (2006).

Ptacek, et al., "Channels and Disease—Past, Present, and Future", *Arch. Neurol.*, 61: 1665-1668 (2004).

Quezada, et al., "CD40/CD154 Interactions at the Interface of Tolerance and Immunity", *Annu. Rev. Immunol.*, 22; 307-328 (2004).

Quintana, et al., "Calcium-Dependent Activation of T-Lymphocytes", *Eur. J Physiol.*, 450: 1-12 (2005).

Rauer, et al., "Structure-Guided Transformation of Charybdotoxin Yields an Analog That Selectively Targets $Ca^2$+-Activated Over Voltage-Gated K+ Channels", *J Biol. Chem.*, 275(2): 1201-1208 (2000).

Ravin, et al., "Preformulation", *Remington's Pharm. Sci.*, Chapter 75, 1435-1450 (1990).

Reich, et al., "Blocking Ion Channel KCNN4 Alleviates the Symptoms of Experimental Autoimmune Encephalomyelitis in Mice", *Eur. J Immunol.*, 35: 1027-1036 (2005).

Rodríguez, et al., "Novel Interactions Between K+ Channels and Scorpion Toxins", *TRENDS in Pharmacol. Sciences*, 24(5): 222-227 (2003).

Rohatagi, et al., "Pharmacokinetics, Pharmacodynamics, and Safety of Inhaled Cyclosporin A (ADI628) after Single and Repeated Administration in Healthy Male and Female Subjects and Asthmatic Patients", *J Clin. Pharmacol.*, 40: 1211-1226 (2000).

Rus, et al., "The Voltage-Gated Potassium Channel Kv1.3 is Highly Expressed on Inflammatory Infiltrates in Multiple Sclerosis Brain", *PNAS*, 102: 11094-11099 (2005).

Sandler, et al., "Polyoxyalkylation of Hydroxy Compounds", Polymer Synthesis, Academic Press, vol. 3, Chapter 5, pp. 138-161 (1980).

Sarmay, et al., "Mapping and Comparison of the Interaction Sites on the Fc Region of IgG responsible for Triggering Antibody Dependent Cellular Cytotoxicity (ADCC) Through Different Types of Human Fcγ Receptor", *Molecular Immun.*, 29(5): 633-639 (1992).

Sasaki, et al., "Structure-Mutation Analysis of the ATPase Site of *Dictyostelium discoideum* Myosin II", *Adv. Biophys.*, 35: 1-24 (1998).

Schechter, et al., "On the Size of the Active Site in Proteases. I. Papain", *Biochem. and Biophys. Res. Communications.*, 27(2): 157-162 (1967).

Schechter, et al., "On the Active Site of Proteases. III. Mapping the Active Site of Papin; Specific Peptide Inhibitors of Papain", *Biochem. and Biophys. Res. Communications.*, 32(5): 898-902 (1968).

Schmitz, et al., "Design of PAP-1, a Selective Small Molecule Kv1.3 Blocker, for the Suppression of Effector Memory T Cells in Autoimmune Diseases", *Mol. Pharmacol.*, 68(5): 1254-1270 (2005).

Schroder, et al., "Interferon-γ: An Overview of Signals, Mechnisms and Functions", *J Leuk Biol.*, 75: 163-189 (2004).

Shakkottai, et al., "Design and Characterization of a Highly Selective Peptide Inhibitor of the Small Conductance Calcium-Activated $K^+$ Channel, SkCa2", *J of Biological Chem.*, 276(46): 43145-43151 (2001).

Shin, et al., "A T-Type Calcium Channel Required for Normal Function of a Mammalian Mechanoreceptor", *Nature Neuroscience*, 6(7): 724-730 (2003).

Smith, et al., "Pulmonary Deposition and Clearance of Aerosolized Alpha-1-Proteinase Inhibitor Administered to Dogs and to Sheep" *J Clin. Invest.*, 84: 1145-1154 (1989).

Speers, et al., "Activity-Based Protein Profiling in Vivo Using a Copper(I)-Catalyzed Azide-Alkyne [3+2] Cycloaddition", *J Am. Chem. Soc.*, 125: 4686-4687 (2003).

Speers, et al., "Profiling Enzyme Activities in Vivo Using Click Chemistry Methods", *Chem. & Biol.*, 11: 535-546 (2004).

Steiner, D.F., "The Proprotein Convertases", *Curr. Opinion Chem. Biology*, 2: 31-39 (1998).

Stewart, et al., Solid Phase Peptide Synthesis, *W.H. Freeman and Co.*, San Francisco, (1969) (Provided Table of Contents only).

Stocker, et al., "ICA-17043, a Novel Gardos Channel Blocker, Prevents Sickled Red Blood Cell Dehydration In Vitro and In Vivo in SAD Mice", *Blood*, 101: 2412-2418 (2003).

Tang, et al., "Metabolic Regulation of Potassium Channels", *Annu. Rev. Physiol.*, 66: 131-159 (2004).

Todorovic, et al., "Redox Modulation of Peripheral T-type $Ca^{2+}$ Channels in Vivo: Alteration of Nerve Injury-Induced Thermal Hyperalgesia", *Pain*, 109: 328-339 (2004).

Tudor, et al., "Ionisation Behaviour and Solution Properties of the Potassium-Channel Blocker ShK Toxin", *Eur. J Biochem.*, 251: 133-141 (1998).

Turk, et al., "Determination of Protease Cleavage Site Motifs Using Mixture-Based Oriented Peptide Libraries", *Nature Biotechnology*, 19: 661-667 (2001).

Valverde, et al., "Selective Blockage of Voltage-Gated Potassium Channels Reduces Inflammatory Bone Resorption in Experimental Peridontal Disease", *J of Bone and Mineral Res.*, 19(1): 155-164 (2004).

Van den Ouweland, et al., "Structural Homology Between the Human *Fur* gene product and the Subtilisin-Like Protease Encoded by Yeast *KEX2", Nucleic Acids Res.*, 18(3): 664 (1990).

Venkatesh, et al., "Chemical Genetics to Identify NFAT Inhibitors: Potential of Targeting Calcium Moblization in Immunosuppression", *PNAS*, 101(24): 8969-8974 (2004).

Voss, et al., "The Role of Enhancers in the Regulation of Cell-Type-Specific Transcriptional Control", *TIBS*, 11: 287-289 (1986).

Wang, et al., "Polyethylene Glycol-Modified Chimeric Toxin Composed of Transforming Growth Factor α and *Pseudomonas* Exotoxin", *CancerRes.*, 53: 4588-4594 (1993).

Wilson, et al., "Phage Display: Applications, Innovations, and Issues in Phage and Host Biology", *Can. J Microbiol.*, 44: 313-329 (1998).

Winslow, et al., "Calcium Signalling in Lymphocytes", *Curr. Opn. Immun.*, 15: 299-307 (2003).

Wright, et al., "The Importance of Loop Length in the Folding of an Immunoglobulin Domain", *Prot. Eng. Des. & Sel.*, 17(5): 443-453 (2004).

Wulff, et al., "$K^+$ Channel Expression During B Cell Differentiation: Implications for Immunomodulation and Autoimmunity[1]", *J of Immunology*, 173: 776-786 (2004).

Wulff, et al., "The Voltage-Gated Kv1.3 $K^+$ Channel in Effector Memory T Cells as New Target for MS", *J of Clin. Investigation*, 111(11): 1703-1713 (2003).

Wulff, et al., "Delineation of the Clotrimazole/TRAM-34 Binding Site on the Intermediate Conductance Calcium-Activated Potassium Channel, IKCal", *J of Biological Chem.*, 276(34): 32040-32045 (2001).

Xu, et al., "The Voltage-Gated Potassium Channel Kv1.3 Regulates Peripheral Insulin Sensitivity", *PNAS*, 101(9): 3112-3117 (2004).

Xu, et al., "The Voltage-Gated Potassium Channel Kv1.3 Regulates Energy Homeostasis and Body Weight", *Human Molecular Genetics*, 12: 551-559 (2003).

Yazdany, et al., "The Role of CD40 Ligand in Systemic Lupus Erythematosus", *Lupus*, 13: 377-380 (2004).

Yocum, et al., "Microemulsion Formulation of Cyclosporin (Sandimmun Neoral®) vs Sandimmun®: Comparative Safety, Tolerability and Efficacy in Severe Active Rheumatoid Arthritis", *Rheumatology*, 39: 156-164 (2000).

Zalipsky, et al., "Chemistry of Polyethylene Glycol Conjugates with Biologically Active Molecules", *Advanced Drug Del. Rev.*, 16: 157-182 (1995).

Zalipsky, et al., "Use of Functionalized Poly(Ethylene Glycol)s for Modification of Polypeptides", *Poly(Ethylene /Glycol) Chemistry: Biotechnical and Biomedical Applications*, J Harris, Ed., Plenum Press, New York, NY, Chapter 21, pp. 347-368 (1992).

Zhang, et al., "A New Strategy for the Site-Specific Modification of Proteins in Vivo", *Biochem.*, 42: 6735-6746 (2003).

Zitt, et al., "Potent Inhibition of $Ca^{2+}$ Channels and T-Lymphocyte Activation by the Pyrazole Derivative BTP2", *J Biol. Chem.*, 279(13): 12427-12437 (2004).

Bednarek et al., "Chemical synthesis and structure-function studies of margatoxin, a poten inhibitor of voltage-dependent potassium channel in human T lymphocytes", Biochemical and Biophysical Research Communications, 198(2): 619-625, (1994).
Judge et al., "Potassium channel blockers in multiple sclerosis: Neuronal Kv channels and effects of symptomatic treatment", Pharmacology and Therapeutics, Elsevier, GB, 111(1): 224-259, (2006).
Legros, et al., "Influence of a NH2-terminal extension on the activity of KTX2, a K<+> channel blocker purified from *Androctonus australis* scorpion venom", FEBS Letters, Elsevier, Amsterdam, NL, 417(1): 123-129, (1997).
Tytgat, J. et al., "A unified nomenclature for short-chain peptides isolated from scorpion venoms: alpha-KTx molecular subfamilies", Trends in Pharmacological Sciences, Elsevier, Haywarth, GB, 20(11): 444-447, (1999).
Office Action mailed Dec. 23, 2009 on U.S. Appl. No. 11/978,105.
Office Action mailed Dec. 10, 2009 on U.S. Appl. No. 11/978,119.

* cited by examiner

FIG. 3A

```
     ATGGAATGGAGCTGGGTCTTTCTCTTCTTCCTGTCAGTAACGACTGGTGTCCACTCCGAC
1790 +---------+---------+---------+---------+---------+--------- 1849
     TACCTTACCTCGACCCAGAAAGAGAAGAAGGACAGTCATTGCTGACCACAGGTGAGGCTG
a    M  E  W  S  W  V  F  L  F  F  L  S  V  T  T  G  V  H  S  D  -

     AAAACTCACACATGCCCACCGTGCCCAGCACCTGAACTCCTGGGGGGACCGTCAGTCTTC
1850 +---------+---------+---------+---------+---------+--------- 1909
     TTTTGAGTGTGTACGGGTGGCACGGGTCGTGGACTTGAGGACCCCCCTGGCAGTCAGAAG
a    K  T  H  T  C  P  P  C  P  A  P  E  L  L  G  G  P  S  V  F  -

     CTCTTCCCCCCAAAACCCAAGGACACCCTCATGATCTCCCGGACCCCTGAGGTCACATGC
1910 +---------+---------+---------+---------+---------+--------- 1969
     GAGAAGGGGGGTTTTGGGTTCCTGTGGGAGTACTAGAGGGCCTGGGGACTCCAGTGTACG
a    L  F  P  P  K  P  K  D  T  L  M  I  S  R  T  P  E  V  T  C  -

     GTGGTGGTGGACGTGAGCCACGAAGACCCTGAGGTCAAGTTCAACTGGTACGTGGACGGC
1970 +---------+---------+---------+---------+---------+--------- 2029
     CACCACCACCTGCACTCGGTGCTTCTGGGACTCCAGTTCAAGTTGACCATGCACCTGCCG
a    V  V  V  D  V  S  H  E  D  P  E  V  K  F  N  W  Y  V  D  G  -

     GTGGAGGTGCATAATGCCAAGACAAAGCCGCGGGAGGAGCAGTACAACAGCACGTACCGT
2030 +---------+---------+---------+---------+---------+--------- 2089
     CACCTCCACGTATTACGGTTCTGTTTCGGCGCCCTCCTCGTCATGTTGTCGTGCATGGCA
a    V  E  V  H  N  A  K  T  K  P  R  E  E  Q  Y  N  S  T  Y  R  -

     GTGGTCAGCGTCCTCACCGTCCTGCACCAGGACTGGCTGAATGGCAAGGAGTACAAGTGC
2090 +---------+---------+---------+---------+---------+--------- 2149
     CACCAGTCGCAGGAGTGGCAGGACGTGGTCCTGACCGACTTACCGTTCCTCATGTTCACG
a    V  V  S  V  L  T  V  L  H  Q  D  W  L  N  G  K  E  Y  K  C  -

     AAGGTCTCCAACAAAGCCCTCCCAGCCCCCATCGAGAAAACCATCTCCAAAGCCAAAGGG
2150 +---------+---------+---------+---------+---------+--------- 2209
     TTCCAGAGGTTGTTTCGGGAGGGTCGGGGGTAGCTCTTTTGGTAGAGGTTTCGGTTTCCC
a    K  V  S  N  K  A  L  P  A  P  I  E  K  T  I  S  K  A  K  G  -

     CAGCCCCGAGAACCACAGGTGTACACCCTGCCCCCATCCCGGGATGAGCTGACCAAGAAC
2210 +---------+---------+---------+---------+---------+--------- 2269
     GTCGGGGCTCTTGGTGTCCACATGTGGGACGGGGGTAGGGCCCTACTCGACTGGTTCTTG
a    Q  P  R  E  P  Q  V  Y  T  L  P  P  S  R  D  E  L  T  K  N  -

     CAGGTCAGCCTGACCTGCCTGGTCAAAGGCTTCTATCCCAGCGACATCGCCGTGGAGTGG
2270 +---------+---------+---------+---------+---------+--------- 2329
     GTCCAGTCGGACTGGACGGACCAGTTTCCGAAGATAGGGTCGCTGTAGCGGCACCTCACC
a    Q  V  S  L  T  C  L  V  K  G  F  Y  P  S  D  I  A  V  E  W  -

     GAGAGCAATGGGCAGCCGGAGAACAACTACAAGACCACGCCTCCCGTGCTGGACTCCGAC
2330 +---------+---------+---------+---------+---------+--------- 2389
     CTCTCGTTACCCGTCGGCCTCTTGTTGATGTTCTGGTGCGGAGGGCACGACCTGAGGCTG
a    E  S  N  G  Q  P  E  N  N  Y  K  T  T  P  P  V  L  D  S  D  -
```

FIG. 3B

```
     GGCTCCTTCTTCCTCTACAGCAAGCTCACCGTGGACAAGAGCAGGTGGCAGCAGGGGAAC
2390 +---------+---------+---------+---------+---------+--------- 2449
     CCGAGGAAGAAGGAGATGTCGTTCGAGTGGCACCTGTTCTCGTCCACCGTCGTCCCCTTG
a    G  S  F  F  L  Y  S  K  L  T  V  D  K  S  R  W  Q  Q  G  N   -

     GTCTTCTCATGCTCCGTGATGCATGAGGCTCTGCACAACCACTACACGCAGAAGAGCCTC
2450 +---------+---------+---------+---------+---------+--------- 2509
     CAGAAGAGTACGAGGCACTACGTACTCCGAGACGTGTTGGTGATGTGCGTCTTCTCGGAG
a    V  F  S  C  S  V  M  H  E  A  L  H  N  H  Y  T  Q  K  S  L   -

     TCCCTGTCTCCGGGTAAA
2510 +---------+-------- 2527
     AGGGACAGAGGCCCATTT
a    S  L  S  P  G  K   -
```

FIG. 4A

```
       ATGGACAAAACTCACACATGTCCACCTTGTCCAGCTCCGGAACTCCTGGGGGGACCGTCA
     1 ---------+---------+---------+---------+---------+---------+ 60
       TACCTGTTTTGAGTGTGTACAGGTGGAACAGGTCGAGGCCTTGAGGACCCCCCTGGCAGT

a      M  D  K  T  H  T  C  P  P  C  P  A  P  E  L  L  G  G  P  S  -

       GTCTTCCTCTTCCCCCCAAAACCCAAGGACACCCTCATGATCTCCCGGACCCCTGAGGTC
    61 ---------+---------+---------+---------+---------+---------+ 120
       CAGAAGGAGAAGGGGGGTTTTGGGTTCCTGTGGGAGTACTAGAGGGCCTGGGGACTCCAG

a      V  F  L  F  P  P  K  P  K  D  T  L  M  I  S  R  T  P  E  V  -

       ACATGCGTGGTGGTGGACGTGAGCCACGAAGACCCTGAGGTCAAGTTCAACTGGTACGTG
   121 ---------+---------+---------+---------+---------+---------+ 180
       TGTACGCACCACCACCTGCACTCGGTGCTTCTGGGACTCCAGTTCAAGTTGACCATGCAC

a      T  C  V  V  V  D  V  S  H  E  D  P  E  V  K  F  N  W  Y  V  -

       GACGGCGTGGAGGTGCATAATGCCAAGACAAAGCCGCGGGAGGAGCAGTACAACAGCACG
   181 ---------+---------+---------+---------+---------+---------+ 240
       CTGCCGCACCTCCACGTATTACGGTTCTGTTTCGGCGCCCTCCTCGTCATGTTGTCGTGC

a      D  G  V  E  V  H  N  A  K  T  K  P  R  E  E  Q  Y  N  S  T  -

       TACCGTGTGGTCAGCGTCCTCACCGTCCTGCACCAGGACTGGCTGAATGGCAAGGAGTAC
   241 ---------+---------+---------+---------+---------+---------+ 300
       ATGGCACACCAGTCGCAGGAGTGGCAGGACGTGGTCCTGACCGACTTACCGTTCCTCATG

a      Y  R  V  V  S  V  L  T  V  L  H  Q  D  W  L  N  G  K  E  Y  -

       AAGTGCAAGGTCTCCAACAAAGCCCTCCCAGCCCCCATCGAGAAAACCATCTCCAAAGCC
   301 ---------+---------+---------+---------+---------+---------+ 360
       TTCACGTTCCAGAGGTTGTTTCGGGAGGGTCGGGGGTAGCTCTTTTGGTAGAGGTTTCGG

a      K  C  K  V  S  N  K  A  L  P  A  P  I  E  K  T  I  S  K  A  -

       AAAGGGCAGCCCCGAGAACCACAGGTGTACACCCTGCCCCCATCCCGGGATGAGCTGACC
   361 ---------+---------+---------+---------+---------+---------+ 420
       TTTCCCGTCGGGGCTCTTGGTGTCCACATGTGGGACGGGGGTAGGGCCCTACTCGACTGG

a      K  G  Q  P  R  E  P  Q  V  Y  T  L  P  P  S  R  D  E  L  T  -

       AAGAACCAGGTCAGCCTGACCTGCCTGGTCAAAGGCTTCTATCCCAGCGACATCGCCGTG
   421 ---------+---------+---------+---------+---------+---------+ 480
       TTCTTGGTCCAGTCGGACTGGACGGACCAGTTTCCGAAGATAGGGTCGCTGTAGCGGCAC

a      K  N  Q  V  S  L  T  C  L  V  K  G  F  Y  P  S  D  I  A  V  -

       GAGTGGGAGAGCAATGGGCAGCCGGAGAACAACTACAAGACCACGCCTCCCGTGCTGGAC
   481 ---------+---------+---------+---------+---------+---------+ 540
       CTCACCCTCTCGTTACCCGTCGGCCTCTTGTTGATGTTCTGGTGCGGAGGGCACGACCTG
```

```
a        E  W  E  S  N  G  Q  P  E  N  N  Y  K  T  T  P  P  V  L  D   -

         TCCGACGGCTCCTTCTTCCTCTACAGCAAGCTCACCGTGGACAAGAGCAGGTGGCAGCAG
    541  ---------+---------+---------+---------+---------+---------+ 600
         AGGCTGCCGAGGAAGAAGGAGATGTCGTTCGAGTGGCACCTGTTCTCGTCCACCGTCGTC

a        S  D  G  S  F  F  L  Y  S  K  L  T  V  D  K  S  R  W  Q  Q   -

         GGGAACGTCTTCTCATGCTCCGTGATGCATGAGGCTCTGCACAACCACTACACGCAGAAG
    601  ---------+---------+---------+---------+---------+---------+ 660
         CCCTTGCAGAAGAGTACGAGGCACTACGTACTCCGAGACGTGTTGGTGATGTGCGTCTTC

a        G  N  V  F  S  C  S  V  M  H  E  A  L  H  N  H  Y  T  Q  K   -

         AGCCTCTCCCTGTCTCCGGGTAAA
    661  ---------+---------+----  684
         TCGGAGAGGGACAGAGGCCCATTT

a        S  L  S  L  S  P  G  K
```

1 10 20 30

RSCIDTIPKSRCTAFQCKHSMKYRLSFCRKTCGTC

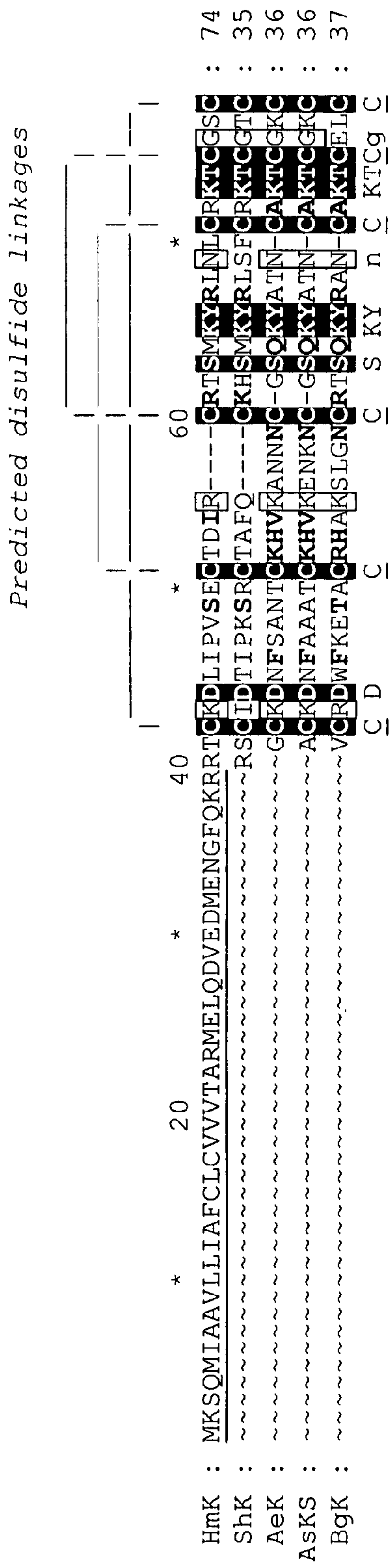
FIG. 6A
FIG. 6B
| Disulfide linkage diagram | Disulfides | Disulfide Bonding |
|---|---|---|
| 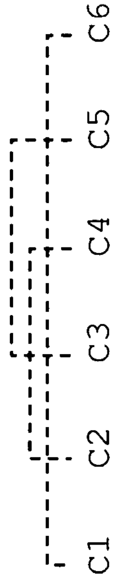 | 3 | C1-C6, C2-C4, C3-C5 |

FIG. 7A

```
                         *       20          *       40         *       60          *                 αKTx   Channels
    BmKK1 : MKIFFAILLILAVCSMAIWTVNGTPFAIKCATDADCSRKC------PGNP---SCRNGFCACT~~~~~~~~~~~~~ : 54   14.1
    BmKK4 : MK-FIIVLILISVLIATIVPVNEA--QTQCQSVRDCQQYC------LTPD---RCSYGTCYCKTTGK~~~~~~~~~ : 55   17.1
    PBTx1 : ~~~~~~~~~~~~~~~~~~~~~~~DEEPKESCSDEMCVIYCKGE-EYSTCV---CDGPQKCKCSD~~~~~~~~~~~~ : 37   11.1   Kv
     Tc32 : ~~~~~~~~~~~~~~~~~~~~~~~~TGPQTTCQAAMCEAGCKGL-GKSMES---CQG-DTCKCKA~~~~~~~~~~~~ : 35   18.1   Kv
    BmKK6 : ~~MSRLFTLVLIVLAMNVMMAIISDPVVEAVGCEECPMHCK---GKNAKP---TCDDGVCNCNV~~~~~~~~~~~~ : 56    9.1
      P01 : ~~~~~~~~~~~~~~~~~~~~~~~~~~~~~VSCEDCPEHCS---TQKAQA---KCDNDKCVCEPI~~~~~~~~~~~ : 29    8.1   SK
      Pi2 : ~~~~~~~~~~~~~~~~~~~~~~~~~~TISCTNPKQCYPHCKKETGYPNA----KCMNRKCKCFGR~~~~~~~~~~~ : 47    7.1   Kv
      Pi3 : ~~~~~~~~~~~~~~~~~~~~~~~~~~TISCTNEKQCYPHCKKETGYPNA----KCMNRKCKCFGR~~~~~~~~~~~ : 35    7.2   Kv
      Pi4 : ~~~~~~~~~~~~~~~~~~~~~~~~IEAIRCGGSRDCYRPCQKRTGCPNA----KCINKTCKCYGCS~~~~~~~~~~ : 38    6.4
      MTX : ~~~~~~~~~~~~~~~~~~~~~~~~~~~VSCTGSKDCYAPCRKQTGCPNA----KCINKSCKCYGC~~~~~~~~~~~ : 34    6.2   IK
      Pi1 : ~~~~~~~~~~~~~~~~~~~~~~~~~~LVKCRGTSDCGRPCQQQTGCPNS----KCINRMCKCYGC~~~~~~~~~~~ : 35    6.1   Kv
    HsTx1 : ~~~~~~~~~~~~~~~~~~~~~~~~~~~ASCRTPKDCADPCRKETGCPYG----KCMNRKCKCNRC~~~~~~~~~~~ : 34    6.3   Kv
    AgTx2 : ~~~~~~~~~~~~~~~~~~~~~~GVPINVSCTGSPQCIKPCKDA-GMRFG----KCMNRKCHCTPK~~~~~~~~~~~ : 38    3.2   Kv
     KTX1 : ~~~~~~~~~~~~~~~~~~~~~~GVEINVKCSGSPQCLKPCKDA-GMRFG----KCMNRKCHCTPK~~~~~~~~~~~ : 38    3.1   Kv
     OSK1 : ~~~~~~~~~~~~~~~~~~~~~~GVIINVKCKISRQCLEPCKKA-GMRFG----KCMNGKCHCTPK~~~~~~~~~~~ : 38    3.7   Kv
    BmKTX : ~MKVFFAVLITLFICSMIIGIHGVGINVKCKHSGQCLKPCKDA-GMRFG----KCINGKCDCTPKG~~~~~~~~~~ : 60    3.6   Kv
    HgTx1 : ~~~~~~~~~~~~~~~~~~~~~~~TVIDVKCTSPKQCLPPCKAQFGIRAGA---KCMNGKCKCYPH~~~~~~~~~~~ : 39    2.5   Kv
     MgTx : ~~~~~~~~~~~~~~~~~~~~~~~TIINVKCTSPKQCLPPCKAQFGQSAGA---KCMNGKCKCYPH~~~~~~~~~~~ : 39    2.2   Kv
    Cl1Tx1 : ~~~~~~~~~~~~~~~~~~~~~~ITINVKCTSPQQCLRPCKDRFGQHAGG---KCMNGKCKCYP~~~~~~~~~~~~ : 38    2.3   BK
      NTX : ~~~~~~~~~~~~~~~~~~~~~~~TIINVKCTSPKQCSKPCKELTGSSAGA---KCMNGKCKCYNN~~~~~~~~~~~ : 39    2.1   Kv
     Tc30 : ~~~~~~~~~~~~~~~~~~~~~~~VFINVKCRGSKECLPACKAAVGKAAG----KCMNGKCKCYP~~~~~~~~~~~~ : 37    4.4   Kv
  TsTX-Ka : ~~~~~~~~~~~~~~~~~~~~~~~VFINAKCRGSPECLPKCKEAIGKAAG----KCMNGKCKCYP~~~~~~~~~~~~ : 37    4.1   Kv
    PBTx3 : ~~~~~~~~~~~~~~~~~~~~~~~~EVDMRCKSSKECLVKCKQATGRPNG----KCMNRKCKCYPR~~~~~~~~~~~ : 37    1.10  Kv
 Lqh 15-1 : ~~~~~~~~~~~~~~~~~~~~~~GLIDVRCYDSRQCWIACKKVTGSTQG----KCQNKQCRCY~~~~~~~~~~~~~ : 36    1.7
 MartenTx : MKIFSILLVALIICSISICTEAFGLIDVKCFASSECWTACKKVTGSGQG----KCQNNQCRCY~~~~~~~~~~~~~ : 59   16.2   BK
     ChTx : MKILSVLLLALIICSIVGWSEAQ-FTNVSCTTSKECWSVCQRLHNTSRG----KCMNKKCRCYS~~~~~~~~~~~~ : 59    1.1   Kv,IK, BK
 ChTx-Lq2 : MKILSVLLLALIICSIIDWSEGQ-FTQESCTASNQCWSICKRLHNTNRG----KCMNKKCRCYS~~~~~~~~~~~~ : 59    1.2   IK, BK
     IbTx : ~~~~~~~~~~~~~~~~~~~~~~Q-FTDVDCSVSKECWSVCKDLFGVDRG----KCMGKKCRCYQ~~~~~~~~~~~~ : 37    1.3   BK
    SloTx : ~~~~~~~~~~~~~~~~~~~~~~T-FIDVDCTVSKECWAPCKAAFGVDRG----KCMGKKCRCYV~~~~~~~~~~~~ : 37    1.11  BK
    BmTx1 : ~MKISFLLLALVICSI-GWSEAQ-FTDVKCTGSKQCWPVCKQMFGKPNG----KCMNGKCRCYS~~~~~~~~~~~~ : 57    1.5   BK, Kv
```

FIG. 8

| | | | | Source | Target | Cys |
|---|---|---|---|---|---|---|
| | | * 20 * 40 * 60 | | | | |
| Apamin | : | ~~~~~~CNC-KAPETALCAR-R--CQ-QHG~~~~~~~~~~~~~~~~~~~~~~~~~~~~~~~~~~ | : 19 | bee | SKCa | 4 |
| HaTx1 | : | ECRYLFGGC-KTTSD--CCK-HLGCKFRDKYCAWDFTFS~~~~~~~~~~~~~~~~~~~~~~~~~ | : 35 | tarantula | Kv2.1 | 6 |
| ProTx1 | : | ECRYWLGGC-SAGQT--CCK-HLVCSRRHGWCVWDGTFS~~~~~~~~~~~~~~~~~~~~~~~~~ | : 35 | tarantula | T type Ca | 6 |
| PaTx2 | : | YCQKWMWTC-D--EERKCCE-GLVCRL---WCKRIINM~~~~~~~~~~~~~~~~~~~~~~~~~~~ | : 31 | tarantula | Kv4.3 | 6 |
| ShK[2-35] | : | ~~~~~~~SCIDTIPKSRCTA--FQCKHSMKYRLSF-C-RKTCGTC~~~~~~~~~~~~~~~~~~~ | : 34 | sea anemone | Kv1.3 | 6 |
| ShK[1-35] | : | ~~~~~~RSCIDTIPKSRCTA--FQCKHSMKYRLSF-C-RKTCGTC~~~~~~~~~~~~~~~~~~~ | : 35 | sea anemone | Kv1.3 | 6 |
| HmK | : | ~~~~~~RTCKDLIPVSECTD--IRCRTSMKYRLNL-C-RKTCGSC~~~~~~~~~~~~~~~~~~~ | : 35 | sea anemone | Kv | 6 |
| ChTx(K32E) | : | ~~QFTNVSC--TTSK-ECWS---VCQRLHNTSRG-KCMNKEC-RCYS~~~~~~~~~~~~~~~~~ | : 37 | scorpion | IKCa | 6 |
| ChTx | : | ~~QFTNVSC--TTSK-ECWS---VCQRLHNTSRG-KCMNKKC-RCYS~~~~~~~~~~~~~~~~~ | : 37 | scorpion | Kv1.3, IK, BK | 6 |
| IbTx | : | ~~QFTDVDC--SVSK-ECWS---VCKDLFGVDRG-KCMGKKC-RCYQ~~~~~~~~~~~~~~~~~ | : 37 | scorpion | BKCa | 6 |
| OSK1(E16K,K20D) | : | ~GVIINVKC--KISR-QCLKP---CKDA-GMRFG-KCMNGKC-HCTPK~~~~~~~~~~~~~~~~ | : 38 | scorpion | Kv1.3 | 6 |
| OSK1 | : | ~GVIINVKC--KISR-QCLEP---CKKA-GMRFG-KCMNGKC-HCTPK~~~~~~~~~~~~~~~~ | : 38 | scorpion | Kv1.3 | 6 |
| AgTx2 | : | ~GVPINVSC--TGSP-QCIKP---CKDA-GMRFG-KCMNRKC-HCTPK~~~~~~~~~~~~~~~~ | : 38 | scorpion | Kv1.3 | 6 |
| KTX1 | : | ~GVEINVKC--SGSP-QCLKP---CKDA-GMRFG-KCMNRKC-HCTPK~~~~~~~~~~~~~~~~ | : 38 | scorpion | Kv1.3 | 6 |
| MgTx | : | ~~TIINVKC--TSPK-QCLPP---CKAQFGQSAGAKCMNGKC-KCYPH~~~~~~~~~~~~~~~~ | : 39 | scorpion | Kv1.3 | 6 |
| NTX | : | ~~TIINVKC--TSPK-QCSKP---CKELYGSSAGAKCMNGKC-KCYNN~~~~~~~~~~~~~~~~ | : 39 | scorpion | Kv1.3 | 6 |
| MTX | : | ~~~~~~VSC--TGSK-DCYAP---CRKQTGCPNA-KCINKSC-KCYGC~~~~~~~~~~~~~~~~ | : 34 | scorpion | IKCa | 8 |
| Pi2 | : | ~~~~~TISC--TNPK-QCY-P--HCKKETGYPNA-KCMNRKC-KCFGR~~~~~~~~~~~~~~~~ | : 35 | scorpion | Kv1.3 | 6 |
| HsTx1 | : | ~~~~~~ASC--RTPK-DCADP---CRKETGCPYG-KCMNRKC-KCNRC~~~~~~~~~~~~~~~~ | : 34 | scorpion | Kv1.3 | 8 |
| Anuroctoxin | : | ~~~~~~KEC--TGPQ-HCTN---FCRKNK-CTHG-KCMNRKC-KCFNCK~~~~~~~~~~~~~~~ | : 34 | scorpion | Kv1.3 | 8 |
| BeKm1 | : | ~~RPTDIKC--SESY-QCF-P--VCKSRFGKTNG-RCVNGFC-DCF~~~~~~~~~~~~~~~~~~ | : 36 | scorpion | M current | 6 |
| ScyTx | : | ~~~~~~AFC--NL-R-MC-QL--SCRSL-GL-LG-KCIGDKC-ECVKH~~~~~~~~~~~~~~~~ | : 31 | scorpion | SKCa | 6 |
| wGVIA | : | ~~~~~~~~~~~~~~~~~CKSPGSSCSP-TSY-------N--C--C----R-SCNPYTKRCYG~ | : 28 | snail | N type Ca | 6 |
| wMVIIa | : | ~~~~~~~~~~~~~~~~~CKGKGAKCSR-LMY-------D--C--C----TGSCR--SGKC-G~ | : 26 | snail | N type Ca | 6 |
| Ptu1 | : | ~~~~~~~~~~~~~AEK-DCIAPGAPCFG-TDK-------P--C--CNP--RAWCSSYANKCL~~ | : 34 | bug | N type Ca | 6 |
| CTX | : | ~~~~~~~~~~~~~~~~MCM-P---CFT-TDHQMARKCDD--C--CGGKGRGKC--YGPQCLCR | : 36 | scorpion | Cl | 8 |
| | | C C C c C C | | | | |

FIG. 9

| Disulfide linkage diagram | Disulfides | Disulfide Bonding | Members |
| --- | --- | --- | --- |
| 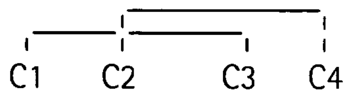 | 2 | C1-C3, C2-C4 | Apamin<br>α-conopeptides<br>PnIA, PnIB, MII |
| 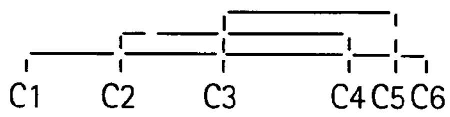 | 3 | C1-C6, C2-C4, C3-C5 | ShK, BgK, HmK<br>AsKS, AeK, DTX1 |
| 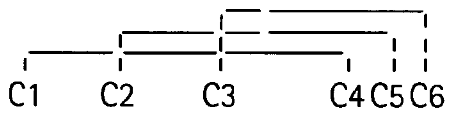 | 3 | C1-C4, C2-C5, C3-C6 | ChTX, MgTx, OSK1, KTX1,<br>AgTx2, Pi2, Pi3, NTX,<br>HgTx1, BeKM1, BmKTX, P01,<br>BmKK6, Tc32, Tc1, BmTx1<br>BmTX3,Ib,Tx, P05, ScyTx,<br>TsK, MaTx1, ProTX1, PaTX2,<br>Ptu1,v GVIA,V MVIIA, SmIIIa |
| 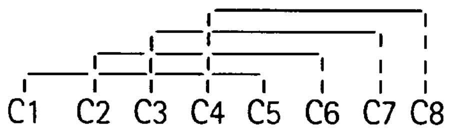 | 4 | C1-C5, C2-C6<br>C3-C7, C4-C8 | Anuroctoxin, Pil, MsTx1<br>MTX(P12A,P20A), Pi4 |
| 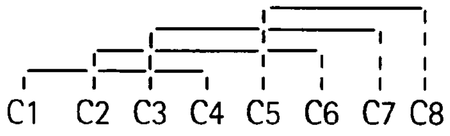 | 4 | C1-C4, C2-C6<br>C3-C7, C5-C8 | Chlorotoxin(CTX), BM-12b |
| 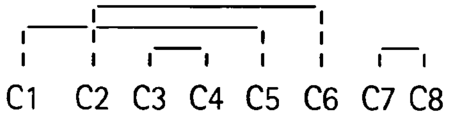 | 4 | C1-C5, C2-C6<br>C3-C4, C7-C8 | Maurotoxin(MTX) |

FIG. 11A

```
      NdeI
       |
      CATATGGACAAAACTCACACATGTCCACCTTGTCCAGCTCCGGAACTCCTGGGGGGACCG
 5131 ---------+---------+---------+---------+---------+---------+ 5190
      GTATACCTGTTTTGAGTGTGTACAGGTGGAACAGGTCGAGGCCTTGAGGACCCCCCTGGC

        M  D  K  T  H  T  C  P  P  C  P  A  P  E  L  L  G  G  P   -

      TCAGTCTTCCTCTTCCCCCCAAAACCCAAGGACACCCTCATGATCTCCCGGACCCCTGAG
 5191 ---------+---------+---------+---------+---------+---------+ 5250
      AGTCAGAAGGAGAAGGGGGGTTTTGGGTTCCTGTGGGAGTACTAGAGGGCCTGGGGACTC

      S  V  F  L  F  P  P  K  P  K  D  T  L  M  I  S  R  T  P  E   -

      GTCACATGCGTGGTGGTGGACGTGAGCCACGAAGACCCTGAGGTCAAGTTCAACTGGTAC
 5251 ---------+---------+---------+---------+---------+---------+ 5310
      CAGTGTACGCACCACCACCTGCACTCGGTGCTTCTGGGACTCCAGTTCAAGTTGACCATG

      V  T  C  V  V  V  D  V  S  H  E  D  P  E  V  K  F  N  W  Y   -

      GTGGACGGCGTGGAGGTGCATAATGCCAAGACAAAGCCGCGGGAGGAGCAGTACAACAGC
 5311 ---------+---------+---------+---------+---------+---------+ 5370
      CACCTGCCGCACCTCCACGTATTACGGTTCTGTTTCGGCGCCCTCCTCGTCATGTTGTCG

      V  D  G  V  E  V  H  N  A  K  T  K  P  R  E  E  Q  Y  N  S   -

      acgtaccgtgtggtcagcgtcctcaccgtcctgcaccaggactggctgaatggcaaggag
 5371 ---------+---------+---------+---------+---------+---------+ 5430
      tgcatggcacaccagtcgcaggagtggcaggacgtggtcctgaccgacttaccgttcctc

      T  Y  R  V  V  S  V  L  T  V  L  H  Q  D  W  L  N  G  K  E   -

      tacaagtgcaaggtctccaacaaagccctcccagcccccatcgagaaaaccatctccaaa
 5431 ---------+---------+---------+---------+---------+---------+ 5490
      atgttcacgttccagaggttgtttcgggagggtcgggggtagctcttttggtagaggttt

      Y  K  C  K  V  S  N  K  A  L  P  A  P  I  E  K  T  I  S  K   -

      gccaaagggcagccccGAGAACCACAGGTGTACACCCTGCCCCCATCCCGGGATGAGCTG
 5491 ---------+---------+---------+---------+---------+---------+ 5550
      cggtttcccgtcggggCTCTTGGTGTCCACATGTGGGACGGGGGTAGGGCCCTACTCGAC

      A  K  G  Q  P  R  E  P  Q  V  Y  T  L  P  P  S  R  D  E  L   -

      ACCAAGAACCAGGTCAGCCTGACCTGCCTGGTCAAAGGCTTCTATCCCAGCGACATCGCC
 5551 ---------+---------+---------+---------+---------+---------+ 5610
      TGGTTCTTGGTCCAGTCGGACTGGACGGACCAGTTTCCGAAGATAGGGTCGCTGTAGCGG

      T  K  N  Q  V  S  L  T  C  L  V  K  G  F  Y  P  S  D  I  A   -

      GTGGAGTGGGAGAGCAATGGGCAGCCGGAGAACAACTACAAGACCACGCCTCCCGTGCTG
 5611 ---------+---------+---------+---------+---------+---------+ 5670
      CACCTCACCCTCTCGTTACCCGTCGGCCTCTTGTTGATGTTCTGGTGCGGAGGGCACGAC

      V  E  W  E  S  N  G  Q  P  E  N  N  Y  K  T  T  P  P  V  L   -
```

```
     GACTCCGACGGCTCCTTCTTCCTCTACAGCAAGCTCACCGTGGACAAGAGCAGGTGGCAG
5671 ---------+---------+---------+---------+---------+---------+ 5730
     CTGAGGCTGCCGAGGAAGAAGGAGATGTCGTTCGAGTGGCACCTGTTCTCGTCCACCGTC

     D  S  D  G  S  F  F  L  Y  S  K  L  T  V  D  K  S  R  W  Q   -

     CAGGGGAACGTCTTCTCATGCTCCGTGATGCATGAGGCTCTGCACAACCACTACACGCAG
5731 ---------+---------+---------+---------+---------+---------+ 5790
     GTCCCCTTGCAGAAGAGTACGAGGCACTACGTACTCCGAGACGTGTTGGTGATGTGCGTC

     Q  G  N  V  F  S  C  S  V  M  H  E  A  L  H  N  H  Y  T  Q   -

                                   BsmBI
                                     |
     AAGAGCCTCTCCCTGTCTCCGGGTAAAGGTGGAGGTGGTGGTTGAGACGCTGCAGGACGT
5791 ---------+---------+---------+---------+---------+---------+ 5850
     TTCTCGGAGAGGGACAGAGGCCCATTTCCACCTCCACCACCAACTCTGCGACGTCCTGCA

     K  S  L  S  L  S  P  G  K  G  G  G  G  G                     -

     TGATCGGCACGTAAGAGGTTCCAACTTTCACCATAATGAAATAAGATCACTACCGGGCGT
5851 ---------+---------+---------+---------+---------+---------+ 5910
     ACTAGCCGTGCATTCTCCAAGGTTGAAAGTGGTATTACTTTATTCTAGTGATGGCCCGCA

     ATTTTTTGAGTTATCGAGATTTTCAGGAGCTAAGGAAGCCAAAATGGAGAAAAAAATCAC
5911 ---------+---------+---------+---------+---------+---------+ 5970
     TAAAAAACTCAATAGCTCTAAAAGTCCTCGATTCCTTCGGTTTTACCTCTTTTTTTAGTG

                                                M  E  K  K  I  T  -

     TGGATATACCACCgttgatatatcccaatggcatcgtaaagaacatttTGaggcatTtca
5971 ---------+---------+---------+---------+---------+---------+ 6030
     ACCTATATGGTGGcaactatatagggttaccgtagcatttcttgtaaaACtccgtaAagt

      G  Y  T  T  V  D  I  S  Q  W  H  R  K  E  H  F  E  A  F  Q  -

     gtcagttgctcaatgtacctataaccagaccgttcagctggatattacggcctttttaaa
6031 ---------+---------+---------+---------+---------+---------+ 6090
     cagtcaacgagttacatggatattggtctggcaagtcgacctataatgccggaaaaattt

      S  V  A  Q  C  T  Y  N  Q  T  V  Q  L  D  I  T  A  F  L  K  -

     gaccgtaaagaaaaataagcacaagttttatccggcctttattcacattcttgcccgcct
6091 ---------+---------+---------+---------+---------+---------+ 6150
     ctggcatttctttttattcgtgttcaaaataggccggaaataagtgtaagaacgggcgga

      T  V  K  K  N  K  H  K  F  Y  P  A  F  I  H  I  L  A  R  L  -

     gatgaatgctcatccggaattccgtatggcaATGAAAGACGGTGAGCTGGTGATATGGGA
6151 ---------+---------+---------+---------+---------+---------+ 6210
     ctacttacgagtaggccttaaggcataccgtTACTTTCTGCCACTCGACCACTATACCCT

      M  N  A  H  P  E  F  R  M  A  M  K  D  G  E  L  V  I  W  D  -
```

```
     TAGTGTTCACCCTTGTTACACCGTTTTCCATGAGCAAACTGAAACGTTTTCATCGCTATG
6211 ---------+---------+---------+---------+---------+---------+ 6270
     ATCACAAGTGGGAACAATGTGGCAAAAGGTACTCGTTTGACTTTGCAAAAGTAGCGATAC

      S  V  H  P  C  Y  T  V  F  H  E  Q  T  E  T  F  S  S  L  W  -

     GAGTGAATACCACGACGATTCCCGGCAGTTTCTACACATATATTCGCAAGATGTGGCGTG
6271 ---------+---------+---------+---------+---------+---------+ 6330
     CTCACTTATGGTGCTGCTAAGGGCCGTCAAAGATGTGTATATAAGCGTTCTACACCGCAC

      S  E  Y  H  D  D  S  R  Q  F  L  H  I  Y  S  Q  D  V  A  C  -

     TTACGGTGAAAACCTGGCCTATTTCCCTAAAGGGTTTATTGAGAATATGTTTTTCGTTTC
6331 ---------+---------+---------+---------+---------+---------+ 6390
     AATGCCACTTTTGGACCGGATAAAGGGATTTCCCAAATAACTCTTATACAAAAAGCAAAG

      Y  G  E  N  L  A  Y  F  P  K  G  F  I  E  N  M  F  F  V  S  -

     AGCCAATCCCTGGGTGAGTTTCACCAGTTTTGATTTAAACGTGGCCAATATGGACAACTT
6391 ---------+---------+---------+---------+---------+---------+ 6450
     TCGGTTAGGGACCCACTCAAAGTGGTCAAAACTAAATTTGCACCGGTTATACCTGTTGAA

      A  N  P  W  V  S  F  T  S  F  D  L  N  V  A  N  M  D  N  F  -

     CTTCGCCCCCGTTTTCACCATGGGCAAATATTATACGCAAGGCGACAAGGTGCTGATGCC
6451 ---------+---------+---------+---------+---------+---------+ 6510
     GAAGCGGGGGCAAAAGTGGTACCCGTTTATAATATGCGTTCCGCTGTTCCACGACTACGG

      F  A  P  V  F  T  M  G  K  Y  Y  T  Q  G  D  K  V  L  M  P  -

     GCTGGCGATTCAGGTTCATCATGCCGTTTGTGATGGCTTCCATGTCGGCAGAATGCTTAA
6511 ---------+---------+---------+---------+---------+---------+ 6570
     CGACCGCTAAGTCCAAGTAGTACGGCAAACACTACCGAAGGTACAGCCGTCTTACGAATT

      L  A  I  Q  V  H  H  A  V  C  D  G  F  H  V  G  R  M  L  N  -

     TGAATTACAACAGTACTGCGATGAGTGGCGGGGCGGGGCGTAATTTTTTTAAGGCAGTTA
6571 ---------+---------+---------+---------+---------+---------+ 6630
     ACTTAATGTTGTCATGACGCTACTCACCGCCCCGCCCCGCATTAAAAAAATTCCGTCAAT

      E  L  Q  Q  Y  C  D  E  W  R  G  G  A  *                   -

                             BamHI
                        BsmBI    |
                             |   |
     TTGGTGGCGCGCCCGTCTCTTAAGGATCCG
6631 ---------+---------+---------+ 6660
     AACCACCGCGCGGGCAGAGAATTCCTAGGC
```

FIG. 12A

```
  BsmBI
   NdeI
     |
     CATATGCGAGACGGGGCGGTGTTGACAATTAATCATCGGCATAGTATATCGGCATAGTAT
5131 ---------+---------+---------+---------+---------+---------+ 5190
     GTATACGCTCTGCCCCGCCACAACTGTTAATTAGTAGCCGTATCATATAGCCGTATCATA

      M

     AATACGACAAGGTGAGGAACTAAACCATGGCCAAGTTGACCAGTGCCGTTCCGGTGCTCA
5191 ---------+---------+---------+---------+---------+---------+ 5250
     TTATGCTGTTCCACTCCTTGATTTGGTACCGGTTCAACTGGTCACGGCAAGGCCACGAGT

                                M  A  K  L  T  S  A  V  P  V  L  T -

     CCGCGCGCGACGTCGCCGGAGCGGTCGAGTTCTGGACCGACCGGCTCGGGTTCTCCCGGG
5251 ---------+---------+---------+---------+---------+---------+ 5310
     GGCGCGCGCTGCAGCGGCCTCGCCAGCTCAAGACCTGGCTGGCCGAGCCCAAGAGGGCCC

       A  R  D  V  A  G  A  V  E  F  W  T  D  R  L  G  F  S  R  D -

     ACTTCGTGGAGGACGACTTCGCCGGTGTGGTCCGGGACGACGTGACCCTGTTCATCAGCG
5311 ---------+---------+---------+---------+---------+---------+ 5370
     TGAAGCACCTCCTGCTGAAGCGGCCACACCAGGCCCTGCTGCACTGGGACAAGTAGTCGC

       F  V  E  D  D  F  A  G  V  V  R  D  D  V  T  L  F  I  S  A -

     CGGTCCAGGACCAGGTGGTGCCGGACAACACCCTGGCCTGGGTGTGGGTGCGCGGCCTGG
5371 ---------+---------+---------+---------+---------+---------+ 5430
     GCCAGGTCCTGGTCCACCACGGCCTGTTGTGGGACCGGACCCACACCCACGCGCCGGACC

       V  Q  D  Q  V  V  P  D  N  T  L  A  W  V  W  V  R  G  L  D -

     ACGAGCTGTACGCCGAGTGGTCGGAGGTCGTGTCCACGAACTTCCGGGACGCCTCCGGGC
5431 ---------+---------+---------+---------+---------+---------+ 5490
     TGCTCGACATGCGGCTCACCAGCCTCCAGCACAGGTGCTTGAAGGCCCTGCGGAGGCCCG

       E  L  Y  A  E  W  S  E  V  V  S  T  N  F  R  D  A  S  G  P -

     CGGCCATGACCGAGATCGGCGAGCAGCCGTGGGGGCGGGAGTTCGCCCTGCGCGACCCGG
5491 ---------+---------+---------+---------+---------+---------+ 5550
     GCCGGTACTGGCTCTAGCCGCTCGTCGGCACCCCCGCCCTCAAGCGGGACGCGCTGGGCC

       A  M  T  E  I  G  E  Q  P  W  G  R  E  F  A  L  R  D  P  A -

     CCGGCAACTGCGTGCACTTCGTGGCCGAGGAGCAGGACTGACACGTCCGACGGCGGCGTC
5551 ---------+---------+---------+---------+---------+---------+ 5610
     GGCCGTTGACGCACGTGAAGCACCGGCTCCTCGTCCTGACTGTGCAGGCTGCCGCCGCAG

       G  N  C  V  H  F  V  A  E  E  Q  D  *
```

```
     BsmBI
       |
     TCAGGTGGTGGTGGTGGTGACAAAACTCACACATGCCCACCGTGCCCAGCACCTGAACTC
5611 ---------+---------+---------+---------+---------+---------+ 5670
     AGTCCACCACCACCACCACTGTTTTGAGTGTGTACGGGTGGCACGGGTCGTGGACTTGAG

        G  G  G  G  G  D  K  T  H  T  C  P  P  C  P  A  P  E  L  -

     CTGGGGGGACCGTCAGTCTTCCTCTTCCCCCCAAAACCCAAGGACACCCTCATGATCTCC
5671 ---------+---------+---------+---------+---------+---------+ 5730
     GACCCCCCTGGCAGTCAGAAGGAGAAGGGGGGTTTTGGGTTCCTGTGGGAGTACTAGAGG

     L  G  G  P  S  V  F  L  F  P  P  K  P  K  D  T  L  M  I  S  -

     CGGACCCCTGAGGTCACATGCGTGGTGGTGGACGTGAGCCACGAAGACCCTGAGGTCAAG
5731 ---------+---------+---------+---------+---------+---------+ 5790
     GCCTGGGGACTCCAGTGTACGCACCACCACCTGCACTCGGTGCTTCTGGGACTCCAGTTC

     R  T  P  E  V  T  C  V  V  V  D  V  S  H  E  D  P  E  V  K  -

     TTCAACTGGTACGTGGACGGCGTGGAGGTGCATAATGCCAAGACAAAGCCGCGGGAGGAG
5791 ---------+---------+---------+---------+---------+---------+ 5850
     AAGTTGACCATGCACCTGCCGCACCTCCACGTATTACGGTTCTGTTTCGGCGCCCTCCTC

     F  N  W  Y  V  D  G  V  E  V  H  N  A  K  T  K  P  R  E  E  -

     CAGTACAACAGCACGTACCGTGTGGTCAGCGTCCTCACCGTCCTGCACCAGGACTGGCTG
5851 ---------+---------+---------+---------+---------+---------+ 5910
     GTCATGTTGTCGTGCATGGCACACCAGTCGCAGGAGTGGCAGGACGTGGTCCTGACCGAC

     Q  Y  N  S  T  Y  R  V  V  S  V  L  T  V  L  H  Q  D  W  L  -

     AATGGCAAGGAGTACAAGTGCAAGGTCTCCAACAAAGCCCTCCCAGCCCCCATCGAGAAA
5911 ---------+---------+---------+---------+---------+---------+ 5970
     TTACCGTTCCTCATGTTCACGTTCCAGAGGTTGTTTCGGGAGGGTCGGGGGTAGCTCTTT

     N  G  K  E  Y  K  C  K  V  S  N  K  A  L  P  A  P  I  E  K  -

     ACCATCTCCAAAGCCAAAGGGCAGCCCCGAGAACCACAGGTGTACACCCTGCCCCCATCC
5971 ---------+---------+---------+---------+---------+---------+ 6030
     TGGTAGAGGTTTCGGTTTCCCGTCGGGGCTCTTGGTGTCCACATGTGGGACGGGGGTAGG

     T  I  S  K  A  K  G  Q  P  R  E  P  Q  V  Y  T  L  P  P  S  -

     CGGGATGAGCTGACCAAGAACCAGGTCAGCCTGACCTGCCTGGTCAAAGGCTTCTATCCC
6031 ---------+---------+---------+---------+---------+---------+ 6090
     GCCCTACTCGACTGGTTCTTGGTCCAGTCGGACTGGACGGACCAGTTTCCGAAGATAGGG
```

```
     R   D   E   L   T   K   N   Q   V   S   L   T   C   L   V   K   G   F   Y   P   -

     AGCGACATCGCCGTGGAGTGGGAGAGCAATGGGCAGCCGGAGAACAACTACAAGACCACG
6091 ---------+---------+---------+---------+---------+---------+ 6150
     TCGCTGTAGCGGCACCTCACCCTCTCGTTACCCGTCGGCCTCTTGTTGATGTTCTGGTGC

     S   D   I   A   V   E   W   E   S   N   G   Q   P   E   N   N   Y   K   T   T   -

     CCTCCCGTGCTGGACTCCGACGGCTCCTTCTTCCTCTACAGCAAGCTCACCGTGGACAAG
6151 ---------+---------+---------+---------+---------+---------+ 6210
     GGAGGGCACGACCTGAGGCTGCCGAGGAAGAAGGAGATGTCGTTCGAGTGGCACCTGTTC

     P   P   V   L   D   S   D   G   S   F   F   L   Y   S   K   L   T   V   D   K   -

     AGCAGGTGGCAGCAGGGGAACGTCTTCTCATGCTCCGTGATGCATGAGGCTCTGCACAAC
6211 ---------+---------+---------+---------+---------+---------+ 6270
     TCGTCCACCGTCGTCCCCTTGCAGAAGAGTACGAGGCACTACGTACTCCGAGACGTGTTG

     S   R   W   Q   Q   G   N   V   F   S   C   S   V   M   H   E   A   L   H   N   -

                                             BamHI
                                                 |
     CACTACACGCAGAAGAGCCTCTCCCTGTCTCCGGGTAAATAATGGATCC
6271 ---------+---------+---------+---------+--------- 6319
     GTGATGTGCGTCTTCTCGGAGAGGGACAGAGGCCCATTTATTACCTAGG

     H   Y   T   Q   K   S   L   S   L   S   P   G   K   *
```

pAMG21ampR-Pep-Fc

FIG. 12E

```
       BsmBI
    NdeI   |
       |   |
       CATATGGGTCGAGACGGGGCGGTGTTGACAATTAATCATCGGCATAGTATATCGGCATAG
5131   ---------+---------+---------+---------+---------+---------+ 5190
       GTATACCCAGCTCTGCCCCGCCACAACTGTTAATTAGTAGCCGTATCATATAGCCGTATC

          M  G                                                       -

       TATAATACGACAAGGTGAGGAACTAAACCATGGCCAAGTTGACCAGTGCCGTTCCGGTGC
5191   ---------+---------+---------+---------+---------+---------+ 5250
       ATATTATGCTGTTCCACTCCTTGATTTGGTACCGGTTCAACTGGTCACGGCAAGGCCACG

         *  Y  D  K  V  R  N  *  T  M  A  K  L  T  S  A  V  P  V  L -

       TCACCGCGCGCGACGTCGCCGGAGCGGTCGAGTTCTGGACCGACCGGCTCGGGTTCTCCC
5251   ---------+---------+---------+---------+---------+---------+ 5310
       AGTGGCGCGCGCTGCAGCGGCCTCGCCAGCTCAAGACCTGGCTGGCCGAGCCCAAGAGGG

         T  A  R  D  V  A  G  A  V  E  F  W  T  D  R  L  G  F  S  R -

       GGGACTTCGTGGAGGACGACTTCGCCGGTGTGGTCCGGGACGACGTGACCCTGTTCATCA
5311   ---------+---------+---------+---------+---------+---------+ 5370
       CCCTGAAGCACCTCCTGCTGAAGCGGCCACACCAGGCCCTGCTGCACTGGGACAAGTAGT

         D  F  V  E  D  D  F  A  G  V  V  R  D  D  V  T  L  F  I  S -

       GCGCGGTCCAGGACCAGGTGGTGCCGGACAACACCCTGGCCTGGGTGTGGGTGCGCGGCC
5371   ---------+---------+---------+---------+---------+---------+ 5430
       CGCGCCAGGTCCTGGTCCACCACGGCCTGTTGTGGGACCGGACCCACACCCACGCGCCGG

         A  V  Q  D  Q  V  V  P  D  N  T  L  A  W  V  W  V  R  G  L -

       TGGACGAGCTGTACGCCGAGTGGTCGGAGGTCGTGTCCACGAACTTCCGGGACGCCTCCG
5431   ---------+---------+---------+---------+---------+---------+ 5490
       ACCTGCTCGACATGCGGCTCACCAGCCTCCAGCACAGGTGCTTGAAGGCCCTGCGGAGGC

         D  E  L  Y  A  E  W  S  E  V  V  S  T  N  F  R  D  A  S  G -

       GGCCGGCCATGACCGAGATCGGCGAGCAGCCGTGGGGGCGGGAGTTCGCCCTGCGCGACC
5491   ---------+---------+---------+---------+---------+---------+ 5550
       CCGGCCGGTACTGGCTCTAGCCGCTCGTCGGCACCCCCGCCCTCAAGCGGGACGCGCTGG

         P  A  M  T  E  I  G  E  Q  P  W  G  R  E  F  A  L  R  D  P -

       CGGCCGGCAACTGCGTGCACTTCGTGGCCGAGGAGCAGGACTGACACGTCCGACGGCGGC
5551   ---------+---------+---------+---------+---------+---------+ 5610
       GCCGGCCGTTGACGCACGTGAAGCACCGGCTCCTCGTCCTGACTGTGCAGGCTGCCGCCG

       A  G  N  C  V  H  F  V  A  E  E  Q  D  *                     -
```

```
 BsmBI
     |
     GTCTCAGGTGGTGGTGGTGGTGACAAAACTCACACATGCCCACCGTGCCCAGCACCTGAA
5611 ---------+---------+---------+---------+---------+---------+ 5670
     CAGAGTCCACCACCACCACCACTGTTTTGAGTGTGTACGGGTGGCACGGGTCGTGGACTT

           G  G  G  G  G  D  K  T  H  T  C  P  P  C  P  A  P  E   -

     CTCCTGGGGGGACCGTCAGTCTTCCTCTTCCCCCCAAAACCCAAGGACACCCTCATGATC
5671 ---------+---------+---------+---------+---------+---------+ 5730
     GAGGACCCCCCTGGCAGTCAGAAGGAGAAGGGGGGTTTTGGGTTCCTGTGGGAGTACTAG

     L  L  G  G  P  S  V  F  L  F  P  P  K  P  K  D  T  L  M  I   -

     TCCCGGACCCCTGAGGTCACATGCGTGGTGGTGGACGTGAGCCACGAAGACCCTGAGGTC
5731 ---------+---------+---------+---------+---------+---------+ 5790
     AGGGCCTGGGGACTCCAGTGTACGCACCACCACCTGCACTCGGTGCTTCTGGGACTCCAG

     S  R  T  P  E  V  T  C  V  V  V  D  V  S  H  E  D  P  E  V   -

     AAGTTCAACTGGTACGTGGACGGCGTGGAGGTGCATAATGCCAAGACAAAGCCGCGGGAG
5791 ---------+---------+---------+---------+---------+---------+ 5850
     TTCAAGTTGACCATGCACCTGCCGCACCTCCACGTATTACGGTTCTGTTTCGGCGCCCTC

     K  F  N  W  Y  V  D  G  V  E  V  H  N  A  K  T  K  P  R  E   -

     GAGCAGTACAACAGCACGTACCGTGTGGTCAGCGTCCTCACCGTCCTGCACCAGGACTGG
5851 ---------+---------+---------+---------+---------+---------+ 5910
     CTCGTCATGTTGTCGTGCATGGCACACCAGTCGCAGGAGTGGCAGGACGTGGTCCTGACC

     E  Q  Y  N  S  T  Y  R  V  V  S  V  L  T  V  L  H  Q  D  W   -

     CTGAATGGCAAGGAGTACAAGTGCAAGGTCTCCAACAAAGCCCTCCCAGCCCCCATCGAG
5911 ---------+---------+---------+---------+---------+---------+ 5970
     GACTTACCGTTCCTCATGTTCACGTTCCAGAGGTTGTTTCGGGAGGGTCGGGGGTAGCTC

     L  N  G  K  E  Y  K  C  K  V  S  N  K  A  L  P  A  P  I  E   -

     AAAACCATCTCCAAAGCCAAAGGGCAGCCCCGAGAACCACAGGTGTACACCCTGCCCCCA
5971 ---------+---------+---------+---------+---------+---------+ 6030
     TTTTGGTAGAGGTTTCGGTTTCCCGTCGGGGCTCTTGGTGTCCACATGTGGGACGGGGGT

     K  T  I  S  K  A  K  G  Q  P  R  E  P  Q  V  Y  T  L  P  P   -

     TCCCGGGATGAGCTGACCAAGAACCAGGTCAGCCTGACCTGCCTGGTCAAAGGCTTCTAT
6031 ---------+---------+---------+---------+---------+---------+ 6090
     AGGGCCCTACTCGACTGGTTCTTGGTCCAGTCGGACTGGACGGACCAGTTTCCGAAGATA

     S  R  D  E  L  T  K  N  Q  V  S  L  T  C  L  V  K  G  F  Y   -
```

```
     CCCAGCGACATCGCCGTGGAGTGGGAGAGCAATGGGCAGCCGGAGAACAACTACAAGACC
6091 ---------+---------+---------+---------+---------+---------+ 6150
     GGGTCGCTGTAGCGGCACCTCACCCTCTCGTTACCCGTCGGCCTCTTGTTGATGTTCTGG

     P  S  D  I  A  V  E  W  E  S  N  G  Q  P  E  N  N  Y  K  T   -

     ACGCCTCCCGTGCTGGACTCCGACGGCTCCTTCTTCCTCTACAGCAAGCTCACCGTGGAC
6151 ---------+---------+---------+---------+---------+---------+ 6210
     TGCGGAGGGCACGACCTGAGGCTGCCGAGGAAGAAGGAGATGTCGTTCGAGTGGCACCTG

     T  P  P  V  L  D  S  D  G  S  F  F  L  Y  S  K  L  T  V  D   -

     AAGAGCAGGTGGCAGCAGGGGAACGTCTTCTCATGCTCCGTGATGCATGAGGCTCTGCAC
6211 ---------+---------+---------+---------+---------+---------+ 6270
     TTCTCGTCCACCGTCGTCCCCTTGCAGAAGAGTACGAGGCACTACGTACTCCGAGACGTG

     K  S  R  W  Q  Q  G  N  V  F  S  C  S  V  M  H  E  A  L  H   -

                                                   BamHI
                                                       |
     AACCACTACACGCAGAAGAGCCTCTCCCTGTCTCCGGGTAAATAATGGATCC
6271 ---------+---------+---------+---------+---------+-- 6322
     TTGGTGATGTGCGTCTTCTCGGAGAGGGACAGAGGCCCATTTATTACCTAGG

     N  H  Y  T  Q  K  S  L  S  L  S  P  G  K  *          -
```

```
        ATGGAATGGAGCTGGGTCTTTCTCTTCTTCCTGTCAGTAACGACTGGTGTCCACTCCGAC
      1 ---------+---------+---------+---------+---------+---------+ 60
        TACCTTACCTCGACCCAGAAAGAGAAGAAGGACAGTCATTGCTGACCACAGGTGAGGCTG
a        M  E  W  S  W  V  F  L  F  F  L  S  V  T  T  G  V  H  S  D  -
        AAAACTCACACATGCCCACCGTGCCCAGCACCTGAACTCCTGGGGGGACCGTCAGTCTTC
     61 ---------+---------+---------+---------+---------+---------+ 120
        TTTTGAGTGTGTACGGGTGGCACGGGTCGTGGACTTGAGGACCCCCCTGGCAGTCAGAAG
a        K  T  H  T  C  P  P  C  P  A  P  E  L  L  G  G  P  S  V  F  -
        CTCTTCCCCCCAAAACCCAAGGACACCCTCATGATCTCCCGGACCCCTGAGGTCACATGC
    121 ---------+---------+---------+---------+---------+---------+ 180
        GAGAAGGGGGGTTTTGGGTTCCTGTGGGAGTACTAGAGGGCCTGGGGACTCCAGTGTACG
a        L  F  P  P  K  P  K  D  T  L  M  I  S  R  T  P  E  V  T  C  -
        GTGGTGGTGGACGTGAGCCACGAAGACCCTGAGGTCAAGTTCAACTGGTACGTGGACGGC
    181 ---------+---------+---------+---------+---------+---------+ 240
        CACCACCACCTGCACTCGGTGCTTCTGGGACTCCAGTTCAAGTTGACCATGCACCTGCCG
a        V  V  V  D  V  S  H  E  D  P  E  V  K  F  N  W  Y  V  D  G  -
        GTGGAGGTGCATAATGCCAAGACAAAGCCGCGGGAGGAGCAGTACAACAGCACGTACCGT
    241 ---------+---------+---------+---------+---------+---------+ 300
        CACCTCCACGTATTACGGTTCTGTTTCGGCGCCCTCCTCGTCATGTTGTCGTGCATGGCA
a        V  E  V  H  N  A  K  T  K  P  R  E  E  Q  Y  N  S  T  Y  R  -
        GTGGTCAGCGTCCTCACCGTCCTGCACCAGGACTGGCTGAATGGCAAGGAGTACAAGTGC
    301 ---------+---------+---------+---------+---------+---------+ 360
        CACCAGTCGCAGGAGTGGCAGGACGTGGTCCTGACCGACTTACCGTTCCTCATGTTCACG
a        V  V  S  V  L  T  V  L  H  Q  D  W  L  N  G  K  E  Y  K  C  -
        AAGGTCTCCAACAAAGCCCTCCCAGCCCCCATCGAGAAAACCATCTCCAAAGCCAAAGGG
    361 ---------+---------+---------+---------+---------+---------+ 420
        TTCCAGAGGTTGTTTCGGGAGGGTCGGGGGTAGCTCTTTTGGTAGAGGTTTCGGTTTCCC
a        K  V  S  N  K  A  L  P  A  P  I  E  K  T  I  S  K  A  K  G  -
        CAGCCCCGAGAACCACAGGTGTACACCCTGCCCCCATCCCGGGATGAGCTGACCAAGAAC
    421 ---------+---------+---------+---------+---------+---------+ 480
        GTCGGGGCTCTTGGTGTCCACATGTGGGACGGGGGTAGGGCCCTACTCGACTGGTTCTTG
a        Q  P  R  E  P  Q  V  Y  T  L  P  P  S  R  D  E  L  T  K  N  -
        CAGGTCAGCCTGACCTGCCTGGTCAAAGGCTTCTATCCCAGCGACATCGCCGTGGAGTGG
    481 ---------+---------+---------+---------+---------+---------+ 540
        GTCCAGTCGGACTGGACGGACCAGTTTCCGAAGATAGGGTCGCTGTAGCGGCACCTCACC
a        Q  V  S  L  T  C  L  V  K  G  F  Y  P  S  D  I  A  V  E  W  -
        GAGAGCAATGGGCAGCCGGAGAACAACTACAAGACCACGCCTCCCGTGCTGGACTCCGAC
    541 ---------+---------+---------+---------+---------+---------+ 600
        CTCTCGTTACCCGTCGGCCTCTTGTTGATGTTCTGGTGCGGAGGGCACGACCTGAGGCTG
a        E  S  N  G  Q  P  E  N  N  Y  K  T  T  P  P  V  L  D  S  D  -
        GGCTCCTTCTTCCTCTACAGCAAGCTCACCGTGGACAAGAGCAGGTGGCAGCAGGGGAAC
    601 ---------+---------+---------+---------+---------+---------+ 660
        CCGAGGAAGAAGGAGATGTCGTTCGAGTGGCACCTGTTCTCGTCCACCGTCGTCCCCTTG
a        G  S  F  F  L  Y  S  K  L  T  V  D  K  S  R  W  Q  Q  G  N  -
        GTCTTCTCATGCTCCGTGATGCATGAGGCTCTGCACAACCACTACACGCAGAAGAGCCTC
    661 ---------+---------+---------+---------+---------+---------+ 720
        CAGAAGAGTACGAGGCACTACGTACTCCGAGACGTGTTGGTGATGTGCGTCTTCTCGGAG
a        V  F  S  C  S  V  M  H  E  A  L  H  N  H  Y  T  Q  K  S  L  -
```

FIG. 14B

```
        TCCCTGTCTCCGGGTAAAGGAGGAGGAGGATCCGGAGGAGGAGGAAGCCGCAGCTGCATC
   721  ---------+---------+---------+---------+---------+---------+ 780
        AGGGACAGAGGCCCATTTCCTCCTCCTCCTAGGCCTCCTCCTCCTTCGGCGTCGACGTAG
a       S  L  S  P  G  K  G  G  G  G  S  G  G  G  G  S  R  S  C  I  -
        GACACCATCCCCAAGAGCCGCTGCACCGCCTTCCAGTGCAAGCACAGCATGAAGTACCGC
   781  ---------+---------+---------+---------+---------+---------+ 840
        CTGTGGTAGGGGTTCTCGGCGACGTGGCGGAAGGTCACGTTCGTGTCGTACTTCATGGCG
a       D  T  I  P  K  S  R  C  T  A  F  Q  C  K  H  S  M  K  Y  R  -
        CTGAGCTTCTGCCGCAAGACCTGCGGCACCTGCTAATGA
   841  ---------+---------+---------+--------- 879
        GACTCGAAGACGGCGTTCTGGACGCCGTGGACGATTACT
a       L  S  F  C  R  K  T  C  G  T  C  *  *  -
```

FIG. 15A

```
      ATGGAATGGAGCTGGGTCTTTCTCTTCTTCCTGTCAGTAACGACTGGTGTCCACTCCGAC
    1 ---------+---------+---------+---------+---------+---------+ 60
      TACCTTACCTCGACCCAGAAAGAGAAGAAGGACAGTCATTGCTGACCACAGGTGAGGCTG
a       M  E  W  S  W  V  F  L  F  F  L  S  V  T  T  G  V  H  S  D  -
      AAAACTCACACATGCCCACCGTGCCCAGCACCTGAACTCCTGGGGGGACCGTCAGTCTTC
   61 ---------+---------+---------+---------+---------+---------+ 120
      TTTTGAGTGTGTACGGGTGGCACGGGTCGTGGACTTGAGGACCCCCCTGGCAGTCAGAAG
a       K  T  H  T  C  P  P  C  P  A  P  E  L  L  G  G  P  S  V  F  -
      CTCTTCCCCCCAAAACCCAAGGACACCCTCATGATCTCCCGGACCCCTGAGGTCACATGC
  121 ---------+---------+---------+---------+---------+---------+ 180
      GAGAAGGGGGGTTTTGGGTTCCTGTGGGAGTACTAGAGGGCCTGGGGACTCCAGTGTACG
a       L  F  P  P  K  P  K  D  T  L  M  I  S  R  T  P  E  V  T  C  -
      GTGGTGGTGGACGTGAGCCACGAAGACCCTGAGGTCAAGTTCAACTGGTACGTGGACGGC
  181 ---------+---------+---------+---------+---------+---------+ 240
      CACCACCACCTGCACTCGGTGCTTCTGGGACTCCAGTTCAAGTTGACCATGCACCTGCCG
a       V  V  V  D  V  S  H  E  D  P  E  V  K  F  N  W  Y  V  D  G  -
      GTGGAGGTGCATAATGCCAAGACAAAGCCGCGGGAGGAGCAGTACAACAGCACGTACCGT
  241 ---------+---------+---------+---------+---------+---------+ 300
      CACCTCCACGTATTACGGTTCTGTTTCGGCGCCCTCCTCGTCATGTTGTCGTGCATGGCA
a       V  E  V  H  N  A  K  T  K  P  R  E  E  Q  Y  N  S  T  Y  R  -
      GTGGTCAGCGTCCTCACCGTCCTGCACCAGGACTGGCTGAATGGCAAGGAGTACAAGTGC
  301 ---------+---------+---------+---------+---------+---------+ 360
      CACCAGTCGCAGGAGTGGCAGGACGTGGTCCTGACCGACTTACCGTTCCTCATGTTCACG
a       V  V  S  V  L  T  V  L  H  Q  D  W  L  N  G  K  E  Y  K  C  -
      AAGGTCTCCAACAAAGCCCTCCCAGCCCCCATCGAGAAAACCATCTCCAAAGCCAAAGGG
  361 ---------+---------+---------+---------+---------+---------+ 420
      TTCCAGAGGTTGTTTCGGGAGGGTCGGGGGTAGCTCTTTTGGTAGAGGTTTCGGTTTCCC
a       K  V  S  N  K  A  L  P  A  P  I  E  K  T  I  S  K  A  K  G  -
      CAGCCCCGAGAACCACAGGTGTACACCCTGCCCCCATCCCGGGATGAGCTGACCAAGAAC
  421 ---------+---------+---------+---------+---------+---------+ 480
      GTCGGGGCTCTTGGTGTCCACATGTGGGACGGGGGTAGGGCCCTACTCGACTGGTTCTTG
a       Q  P  R  E  P  Q  V  Y  T  L  P  P  S  R  D  E  L  T  K  N  -
      CAGGTCAGCCTGACCTGCCTGGTCAAAGGCTTCTATCCCAGCGACATCGCCGTGGAGTGG
  481 ---------+---------+---------+---------+---------+---------+ 540
      GTCCAGTCGGACTGGACGGACCAGTTTCCGAAGATAGGGTCGCTGTAGCGGCACCTCACC
a       Q  V  S  L  T  C  L  V  K  G  F  Y  P  S  D  I  A  V  E  W  -
      GAGAGCAATGGGCAGCCGGAGAACAACTACAAGACCACGCCTCCCGTGCTGGACTCCGAC
  541 ---------+---------+---------+---------+---------+---------+ 600
      CTCTCGTTACCCGTCGGCCTCTTGTTGATGTTCTGGTGCGGAGGGCACGACCTGAGGCTG
a       E  S  N  G  Q  P  E  N  N  Y  K  T  T  P  P  V  L  D  S  D  -
      GGCTCCTTCTTCCTCTACAGCAAGCTCACCGTGGACAAGAGCAGGTGGCAGCAGGGGAAC
  601 ---------+---------+---------+---------+---------+---------+ 660
      CCGAGGAAGAAGGAGATGTCGTTCGAGTGGCACCTGTTCTCGTCCACCGTCGTCCCCTTG
a       G  S  F  F  L  Y  S  K  L  T  V  D  K  S  R  W  Q  Q  G  N  -
      GTCTTCTCATGCTCCGTGATGCATGAGGCTCTGCACAACCACTACACGCAGAAGAGCCTC
  661 ---------+---------+---------+---------+---------+---------+ 720
      CAGAAGAGTACGAGGCACTACGTACTCCGAGACGTGTTGGTGATGTGCGTCTTCTCGGAG
a       V  F  S  C  S  V  M  H  E  A  L  H  N  H  Y  T  Q  K  S  L  -
```

FIG. 15B

```
    TCCCTGTCTCCGGGTAAAGGAGGAGGAGGATCCGGAGGAGGAGGAAGCAGCTGCATCGAC
721 ---------+---------+---------+---------+---------+---------+ 780
    AGGGACAGAGGCCCATTTCCTCCTCCTCCTAGGCCTCCTCCTCCTTCGTCGACGTAGCTG
a   S  L  S  P  G  K  G  G  G  G  S  G  G  G  G  S  S  C  I  D  -
    ACCATCCCCAAGAGCCGCTGCACCGCCTTCCAGTGCAAGCACAGCATGAAGTACCGCCTG
781 ---------+---------+---------+---------+---------+---------+ 840
    TGGTAGGGGTTCTCGGCGACGTGGCGGAAGGTCACGTTCGTGTCGTACTTCATGGCGGAC
a   T  I  P  K  S  R  C  T  A  F  Q  C  K  H  S  M  K  Y  R  L  -
    AGCTTCTGCCGCAAGACCTGCGGCACCTGCTAA
841 ---------+---------+---------+--- 873
    TCGAAGACGGCGTTCTGGACGCCGTGGACGATT
a   S  F  C  R  K  T  C  G  T  C  *  -
```

FIG. 16A

```
        ATGGAATGGAGCTGGGTCTTTCTCTTCTTCCTGTCAGTAACGACTGGTGTCCACTCCGAC
      1 ---------+---------+---------+---------+---------+---------+ 60
        TACCTTACCTCGACCCAGAAAGAGAAGAAGGACAGTCATTGCTGACCACAGGTGAGGCTG
a        M  E  W  S  W  V  F  L  F  F  L  S  V  T  T  G  V  H  S  D  -
        AAAACTCACACATGCCCACCGTGCCCAGCACCTGAACTCCTGGGGGGACCGTCAGTCTTC
     61 ---------+---------+---------+---------+---------+---------+ 120
        TTTTGAGTGTGTACGGGTGGCACGGGTCGTGGACTTGAGGACCCCCCTGGCAGTCAGAAG
a        K  T  H  T  C  P  P  C  P  A  P  E  L  L  G  G  P  S  V  F  -
        CTCTTCCCCCCAAAACCCAAGGACACCCTCATGATCTCCCGGACCCCTGAGGTCACATGC
    121 ---------+---------+---------+---------+---------+---------+ 180
        GAGAAGGGGGGTTTTGGGTTCCTGTGGGAGTACTAGAGGGCCTGGGGACTCCAGTGTACG
a        L  F  P  P  K  P  K  D  T  L  M  I  S  R  T  P  E  V  T  C  -
        GTGGTGGTGGACGTGAGCCACGAAGACCCTGAGGTCAAGTTCAACTGGTACGTGGACGGC
    181 ---------+---------+---------+---------+---------+---------+ 240
        CACCACCACCTGCACTCGGTGCTTCTGGGACTCCAGTTCAAGTTGACCATGCACCTGCCG
a        V  V  V  D  V  S  H  E  D  P  E  V  K  F  N  W  Y  V  D  G  -
        GTGGAGGTGCATAATGCCAAGACAAAGCCGCGGGAGGAGCAGTACAACAGCACGTACCGT
    241 ---------+---------+---------+---------+---------+---------+ 300
        CACCTCCACGTATTACGGTTCTGTTTCGGCGCCCTCCTCGTCATGTTGTCGTGCATGGCA
a        V  E  V  H  N  A  K  T  K  P  R  E  E  Q  Y  N  S  T  Y  R  -
        GTGGTCAGCGTCCTCACCGTCCTGCACCAGGACTGGCTGAATGGCAAGGAGTACAAGTGC
    301 ---------+---------+---------+---------+---------+---------+ 360
        CACCAGTCGCAGGAGTGGCAGGACGTGGTCCTGACCGACTTACCGTTCCTCATGTTCACG
a        V  V  S  V  L  T  V  L  H  Q  D  W  L  N  G  K  E  Y  K  C  -
        AAGGTCTCCAACAAAGCCCTCCCAGCCCCCATCGAGAAAACCATCTCCAAAGCCAAAGGG
    361 ---------+---------+---------+---------+---------+---------+ 420
        TTCCAGAGGTTGTTTCGGGAGGGTCGGGGGTAGCTCTTTTGGTAGAGGTTTCGGTTTCCC
a        K  V  S  N  K  A  L  P  A  P  I  E  K  T  I  S  K  A  K  G  -
        CAGCCCCGAGAACCACAGGTGTACACCCTGCCCCCATCCCGGGATGAGCTGACCAAGAAC
    421 ---------+---------+---------+---------+---------+---------+ 480
        GTCGGGGCTCTTGGTGTCCACATGTGGGACGGGGGTAGGGCCCTACTCGACTGGTTCTTG
a        Q  P  R  E  P  Q  V  Y  T  L  P  P  S  R  D  E  L  T  K  N  -
        CAGGTCAGCCTGACCTGCCTGGTCAAAGGCTTCTATCCCAGCGACATCGCCGTGGAGTGG
    481 ---------+---------+---------+---------+---------+---------+ 540
        GTCCAGTCGGACTGGACGGACCAGTTTCCGAAGATAGGGTCGCTGTAGCGGCACCTCACC
a        Q  V  S  L  T  C  L  V  K  G  F  Y  P  S  D  I  A  V  E  W  -
        GAGAGCAATGGGCAGCCGGAGAACAACTACAAGACCACGCCTCCCGTGCTGGACTCCGAC
    541 ---------+---------+---------+---------+---------+---------+ 600
        CTCTCGTTACCCGTCGGCCTCTTGTTGATGTTCTGGTGCGGAGGGCACGACCTGAGGCTG
a        E  S  N  G  Q  P  E  N  N  Y  K  T  T  P  P  V  L  D  S  D  -
        GGCTCCTTCTTCCTCTACAGCAAGCTCACCGTGGACAAGAGCAGGTGGCAGCAGGGGAAC
    601 ---------+---------+---------+---------+---------+---------+ 660
        CCGAGGAAGAAGGAGATGTCGTTCGAGTGGCACCTGTTCTCGTCCACCGTCGTCCCCTTG
a        G  S  F  F  L  Y  S  K  L  T  V  D  K  S  R  W  Q  Q  G  N  -
        GTCTTCTCATGCTCCGTGATGCATGAGGCTCTGCACAACCACTACACGCAGAAGAGCCTC
    661 ---------+---------+---------+---------+---------+---------+ 720
        CAGAAGAGTACGAGGCACTACGTACTCCGAGACGTGTTGGTGATGTGCGTCTTCTCGGAG
a        V  F  S  C  S  V  M  H  E  A  L  H  N  H  Y  T  Q  K  S  L  -
```

FIG. 16B

```
         TCCCTGTCTCCGGGTAAAGGAGGAGGAGGATCCGGGGGTGGGGGTTCTGGGGGTGGGGGT
    721  ---------+---------+---------+---------+---------+---------+ 780
         AGGGACAGAGGCCCATTTCCTCCTCCTCCTAGGCCCCCACCCCCAAGACCCCCACCCCCA
a        S  L  S  P  G  K  G  G  G  G  S  G  G  G  G  S  G  G  G  G   -
         TCTGGAGGAGGAGGAAGCGGAGGAGGAGGAAGCAGCTGCATCGACACCATCCCCAAGAGC
    781  ---------+---------+---------+---------+---------+---------+ 840
         AGACCTCCTCCTCCTTCGCCTCCTCCTCCTTCGTCGACGTAGCTGTGGTAGGGGTTCTCG
a        S  G  G  G  G  S  G  G  G  G  S  S  C  I  D  T  I  P  K  S   -
         CGCTGCACCGCCTTCCAGTGCAAGCACAGCATGAAGTACCGCCTGAGCTTCTGCCGCAAG
    841  ---------+---------+---------+---------+---------+---------+ 900
         GCGACGTGGCGGAAGGTCACGTTCGTGTCGTACTTCATGGCGGACTCGAAGACGGCGTTC
a        R  C  T  A  F  Q  C  K  H  S  M  K  Y  R  L  S  F  C  R  K   -
         ACCTGCGGCACCTGCTAA
    901  ---------+-------- 918
         TGGACGCCGTGGACGATT
a        T  C  G  T  C  *   -
```

A scheme for N-terminal PEGylation of ShK by reductive amination, which is also described in Example 32 hereinafter.

A scheme for N-terminal PEGylation of ShK via amide formation, which is also described in Example 34 hereinafter.

A scheme for N-terminal PEGylation of ShK by chemoselective oxime formation, which is also described in Example 33 hereinafter.

A scheme for N-terminal PEGylation of ShK by reductive amination, which is also described in Example 31 hereinafter.

Peptide 1

Peptide 2

Peptide 3

SDS Page Legend

1. Molecular weight marker
2. 15ul of Fc-L-ShK
3. 10ul of Fc-L-ShK
4. 5ul of Fc-L-ShK
5. Molecular weight marker
6. Blank
7. 15ul of No DNA control
8. 10ul of No DNA control
9. 5ul of No DNA control
10. Molecular weight marker SDS Page Legend 1. blank
2. BB6
3. MWM
4. BB5
5. BB4
6. BB3
7. BB2
8. BB1
9. Blank
10. BD6
11. BD5
12. MWM
13. BD4
14. BD3
15. BD2

HEK 293 Untransfected Cells

HEK 293/hKv1.3 Transfected Cells

Level of Non-Specific Binding

○ α CD32 Ab+[Fc-L10-ShK] IC50=11nM

▲ [Fc-L10-ShK] IC50=7nM

○ α CD32 Ab+[Fc-L10-ShK] IC50=2nM

▲ [Fc-L10-ShK] IC50=1nM

| # Name | Abs<260nm> | Abs<280nm> | Abs<340nm> |
|---|---|---|---|
| 1 PA-Pool | 5.5905E-2 | 9.2075E-2 | 5.6744E-3 |

| # Name | Abs<260nm> | Abs<280nm> | Abs<340nm> |
|---|---|---|---|
| 1 PA-Pool Tx21 | 6.4667E-2 | 0.10996 | -2.1558E-3 |

| # Name | Abs<260nm> | Abs<280nm> | Abs<340nm> |
|---|---|---|---|
| 1 15*OSK-E | 0.18270 | 0.32751 | 6.1255E-3 |

FIG. 42A

```
    atggaatggagctgggtctttctcttcttcctgtcagtaacgactggtgtccactccgac
  1 ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D

    aaaactcacacatgcccaccgtgcccagcacctgaactcctggggggaccgtcagtcttc
 61 ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F

    ctcttccccccaaaacccaaggacaccctcatgatctcccggacccctgaggtcacatgc
121 ---------+---------+---------+---------+---------+---------+ 180
    gagaaggggggttttgggttcctgtgggagtactagagggcctggggactccagtgtacg
    L  F  P  P  K  P  K  D  T  L  M  I  S  R  T  P  E  V  T  C

    gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G

    gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R

    gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C

    aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G

    cagccccgagaaccacaggtgtacaccctgcccccatcccgggatgagctgaccaagaac
421 ---------+---------+---------+---------+---------+---------+ 480
    gtcggggctcttggtgtccacatgtgggacgggggtagggccctactcgactggttcttg
    Q  P  R  E  P  Q  V  Y  T  L  P  P  S  R  D  E  L  T  K  N

    caggtcagcctgacctgcctggtcaaaggcttctatcccagcgacatcgccgtggagtgg
481 ---------+---------+---------+---------+---------+---------+ 540
    gtccagtcggactggacggaccagtttccgaagatagggtcgctgtagcggcacctcacc
    Q  V  S  L  T  C  L  V  K  G  F  Y  P  S  D  I  A  V  E  W

    gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 42B

```
    ggctccttcttcctctacagcaagctcaccgtggacaagagcaggtggcagcaggggaac
601 ---------+---------+---------+---------+---------+---------+ 660
    ccgaggaagaaggagatgtcgttcgagtggcacctgttctcgtccaccgtcgtccccttg
    G  S  F  F  L  Y  S  K  L  T  V  D  K  S  R  W  Q  Q  G  N

    gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
    V  F  S  C  S  V  M  H  E  A  L  H  N  H  Y  T  Q  K  S  L

    tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
    S  L  S  P  G  K  G  G  G  G  S  G  G  G  G  S  G  V  I  I

    aacgtgaagtgcaagatcagccgccagtgcctggagccctgcaagaaggccggcatgcgc
781 ---------+---------+---------+---------+---------+---------+ 840
    ttgcacttcacgttctagtcggcggtcacggacctcgggacgttcttccggccgtacgcg
    N  V  K  C  K  I  S  R  Q  C  L  E  P  C  K  K  A  G  M  R

    ttcggcaagtgcatgaacggcaagtgccactgcacccccaagtagtaa
841 ---------+---------+---------+---------+-------- 888
    aagccgttcacgtacttgccgttcacggtgacgtgggggttcatcatt
    F  G  K  C  M  N  G  K  C  H  C  T  P  K  *  *
```

FIG. 43A

```
    atggaatggagctgggtctttctcttcttcctgtcagtaacgactggtgtccactccgac
  1 ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D

    aaaactcacacatgcccaccgtgcccagcacctgaactcctggggggaccgtcagtcttc
 61 ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F

    ctcttccccccaaaacccaaggacaccctcatgatctcccggacccctgaggtcacatgc
121 ---------+---------+---------+---------+---------+---------+ 180
    gagaaggggggttttgggttcctgtgggagtactagagggcctggggactccagtgtacg
    L  F  P  P  K  P  K  D  T  L  M  I  S  R  T  P  E  V  T  C

    gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G

    gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R

    gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C

    aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G

    cagccccgagaaccacaggtgtacaccctgcccccatcccgggatgagctgaccaagaac
421 ---------+---------+---------+---------+---------+---------+ 480
    gtcggggctcttggtgtccacatgtgggacgggggtagggccctactcgactggttcttg
    Q  P  R  E  P  Q  V  Y  T  L  P  P  S  R  D  E  L  T  K  N

    caggtcagcctgacctgcctggtcaaaggcttctatcccagcgacatcgccgtggagtgg
481 ---------+---------+---------+---------+---------+---------+ 540
    gtccagtcggactggacggaccagtttccgaagatagggtcgctgtagcggcacctcacc
    Q  V  S  L  T  C  L  V  K  G  F  Y  P  S  D  I  A  V  E  W

    gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 43B

```
    ggctccttcttcctctacagcaagctcaccgtggacaagagcaggtggcagcaggggaac
601 ---------+---------+---------+---------+---------+---------+ 660
    ccgaggaagaaggagatgtcgttcgagtggcacctgttctcgtccaccgtcgtccccttg
    G  S  F  F  L  Y  S  K  L  T  V  D  K  S  R  W  Q  Q  G  N

    gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
    V  F  S  C  S  V  M  H  E  A  L  H  N  H  Y  T  Q  K  S  L

    tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
    S  L  S  P  G  K  G  G  G  G  S  G  G  G  G  S  G  V  I  I

    aacgtgagctgcaagatcagccgccagtgcctggagccctgcaagaaggccggcatgcgc
781 ---------+---------+---------+---------+---------+---------+ 840
    ttgcactcgacgttctagtcggcggtcacggacctcgggacgttcttccggccgtacgcg
    N  V  S  C  K  I  S  R  Q  C  L  E  P  C  K  K  A  G  M  R

    ttcggcaagtgcatgaacggcaagtgccactgcacccccaagtagtaa
841 ---------+---------+---------+---------+-------- 888
    aagccgttcacgtacttgccgttcacggtgacgtgggggttcatcatt
    F  G  K  C  M  N  G  K  C  H  C  T  P  K  *  *
```

FIG. 44A

```
    atggaatggagctgggtctttctcttcttcctgtcagtaacgactggtgtccactccgac
  1 ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D

    aaaactcacacatgcccaccgtgcccagcacctgaactcctggggggaccgtcagtcttc
 61 ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F

    ctcttccccccaaaacccaaggacaccctcatgatctcccggacccctgaggtcacatgc
121 ---------+---------+---------+---------+---------+---------+ 180
    gagaaggggggttttgggttcctgtgggagtactagagggcctggggactccagtgtacg
    L  F  P  P  K  P  K  D  T  L  M  I  S  R  T  P  E  V  T  C

    gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G

    gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R

    gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C

    aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G

    cagccccgagaaccacaggtgtacaccctgcccccatcccgggatgagctgaccaagaac
421 ---------+---------+---------+---------+---------+---------+ 480
    gtcggggctcttggtgtccacatgtgggacgggggtagggccctactcgactggttcttg
    Q  P  R  E  P  Q  V  Y  T  L  P  P  S  R  D  E  L  T  K  N

    caggtcagcctgacctgcctggtcaaaggcttctatcccagcgacatcgccgtggagtgg
481 ---------+---------+---------+---------+---------+---------+ 540
    gtccagtcggactggacggaccagtttccgaagatagggtcgctgtagcggcacctcacc
    Q  V  S  L  T  C  L  V  K  G  F  Y  P  S  D  I  A  V  E  W

    gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 44B

```
    ggctccttcttcctctacagcaagctcaccgtggacaagagcaggtggcagcaggggaac
601 ---------+---------+---------+---------+---------+---------+ 660
    ccgaggaagaaggagatgtcgttcgagtggcacctgttctcgtccaccgtcgtccccttg
    G  S  F  F  L  Y  S  K  L  T  V  D  K  S  R  W  Q  Q  G  N

    gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
    V  F  S  C  S  V  M  H  E  A  L  H  N  H  Y  T  Q  K  S  L

    tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
    S  L  S  P  G  K  G  G  G  G  S  G  G  G  G  S  G  V  I  I

    aacgtgaagtgcaagatcagccgccagtgcctgaagccctgcaaggacgccggcatgcgc
781 ---------+---------+---------+---------+---------+---------+ 840
    ttgcacttcacgttctagtcggcggtcacggacttcgggacgttcctgcggccgtacgcg
    N  V  K  C  K  I  S  R  Q  C  L  K  P  C  K  D  A  G  M  R

    ttcggcaagtgcatgaacggcaagtgccactgcacccccaagtagtaa
841 ---------+---------+---------+---------+-------- 888
    aagccgttcacgtacttgccgttcacggtgacgtgggggttcatcatt
    F  G  K  C  M  N  G  K  C  H  C  T  P  K  *  *
```

FIG. 45A

```
    atggaatggagctgggtctttctcttcttcctgtcagtaacgactggtgtccactccgac
  1 ---------+---------+---------+---------+---------+---------+ 60
    taccttacctcgacccagaaagagaagaaggacagtcattgctgaccacaggtgaggctg
    M  E  W  S  W  V  F  L  F  F  L  S  V  T  T  G  V  H  S  D

    aaaactcacacatgcccaccgtgcccagcacctgaactcctggggggaccgtcagtcttc
 61 ---------+---------+---------+---------+---------+---------+ 120
    ttttgagtgtgtacgggtggcacgggtcgtggacttgaggacccccctggcagtcagaag
    K  T  H  T  C  P  P  C  P  A  P  E  L  L  G  G  P  S  V  F

    ctcttccccccaaaacccaaggacaccctcatgatctcccggacccctgaggtcacatgc
121 ---------+---------+---------+---------+---------+---------+ 180
    gagaaggggggttttgggttcctgtgggagtactagagggcctggggactccagtgtacg
    L  F  P  P  K  P  K  D  T  L  M  I  S  R  T  P  E  V  T  C

    gtggtggtggacgtgagccacgaagaccctgaggtcaagttcaactggtacgtggacggc
181 ---------+---------+---------+---------+---------+---------+ 240
    caccaccacctgcactcggtgcttctgggactccagttcaagttgaccatgcacctgccg
    V  V  V  D  V  S  H  E  D  P  E  V  K  F  N  W  Y  V  D  G

    gtggaggtgcataatgccaagacaaagccgcgggaggagcagtacaacagcacgtaccgt
241 ---------+---------+---------+---------+---------+---------+ 300
    cacctccacgtattacggttctgtttcggcgccctcctcgtcatgttgtcgtgcatggca
    V  E  V  H  N  A  K  T  K  P  R  E  E  Q  Y  N  S  T  Y  R

    gtggtcagcgtcctcaccgtcctgcaccaggactggctgaatggcaaggagtacaagtgc
301 ---------+---------+---------+---------+---------+---------+ 360
    caccagtcgcaggagtggcaggacgtggtcctgaccgacttaccgttcctcatgttcacg
    V  V  S  V  L  T  V  L  H  Q  D  W  L  N  G  K  E  Y  K  C

    aaggtctccaacaaagccctcccagcccccatcgagaaaaccatctccaaagccaaaggg
361 ---------+---------+---------+---------+---------+---------+ 420
    ttccagaggttgtttcgggagggtcgggggtagctcttttggtagaggtttcggtttccc
    K  V  S  N  K  A  L  P  A  P  I  E  K  T  I  S  K  A  K  G

    cagccccgagaaccacaggtgtacaccctgcccccatcccgggatgagctgaccaagaac
421 ---------+---------+---------+---------+---------+---------+ 480
    gtcggggctcttggtgtccacatgtgggacgggggtagggccctactcgactggttcttg
    Q  P  R  E  P  Q  V  Y  T  L  P  P  S  R  D  E  L  T  K  N

    caggtcagcctgacctgcctggtcaaaggcttctatcccagcgacatcgccgtggagtgg
481 ---------+---------+---------+---------+---------+---------+ 540
    gtccagtcggactggacggaccagtttccgaagatagggtcgctgtagcggcacctcacc
    Q  V  S  L  T  C  L  V  K  G  F  Y  P  S  D  I  A  V  E  W

    gagagcaatgggcagccggagaacaactacaagaccacgcctcccgtgctggactccgac
541 ---------+---------+---------+---------+---------+---------+ 600
    ctctcgttacccgtcggcctcttgttgatgttctggtgcggagggcacgacctgaggctg
    E  S  N  G  Q  P  E  N  N  Y  K  T  T  P  P  V  L  D  S  D
```

FIG. 45B

```
    ggctccttcttcctctacagcaagctcaccgtggacaagagcaggtggcagcaggggaac
601 ---------+---------+---------+---------+---------+---------+ 660
    ccgaggaagaaggagatgtcgttcgagtggcacctgttctcgtccaccgtcgtccccttg
    G  S  F  F  L  Y  S  K  L  T  V  D  K  S  R  W  Q  Q  G  N

    gtcttctcatgctccgtgatgcatgaggctctgcacaaccactacacgcagaagagcctc
661 ---------+---------+---------+---------+---------+---------+ 720
    cagaagagtacgaggcactacgtactccgagacgtgttggtgatgtgcgtcttctcggag
    V  F  S  C  S  V  M  H  E  A  L  H  N  H  Y  T  Q  K  S  L

    tccctgtctccgggtaaaggaggaggaggatccggaggaggaggaagcggcgtgatcatc
721 ---------+---------+---------+---------+---------+---------+ 780
    agggacagaggcccatttcctcctcctcctaggcctcctcctccttcgccgcactagtag
    S  L  S  P  G  K  G  G  G  G  S  G  G  G  G  S  G  V  I  I

    aacgtgagctgcaagatcagccgccagtgcctgaagccctgcaaggacgccggcatgcgc
781 ---------+---------+---------+---------+---------+---------+ 840
    ttgcactcgacgttctagtcggcggtcacggacttcgggacgttcctgcggccgtacgcg
    N  V  S  C  K  I  S  R  Q  C  L  K  P  C  K  D  A  G  M  R

    ttcggcaagtgcatgaacggcaagtgccactgcacccccaagtagtaa
841 ---------+---------+---------+---------+-------- 888
    aagccgttcacgtacttgccgttcacggtgacgtgggggttcatcatt
    F  G  K  C  M  N  G  K  C  H  C  T  P  K  *  *
```

1. Vehicle (2% Lewis rat serum-PBS) SC d-1-d3
2. ShK 10μg/kg (2.47nmoles/kg) SC d-1-d3
3. PEG-ShK 1μg/kg (0.247nmoles/kg) SC d-1-d3
4. PEG-ShK 10μg/kg (2.47nmoles/kg) SC d-1-d3
5. PEG-ShK 100μg/kg (24.7nmoles/kg) SC d-1-d3

FIG. 70

```
1   mdkthtcppc papellggps vflfppkpkd tlmisrtpev tcvvvdvshe
51  dpevkfnwyv dgvevhnakt kpreeqynst yrvvsvltvl hqdwlngkey
101 kckvsnkalp apiektiska kgqprepqvy tlppsrdelg ggviinvkck
151 isrqclepck kagmrfgkcm ngkchctpkg gtknqvsltc lvkgfypsdi
201 avewesngqp ennykttppv ldsdgsffly skltvdksrw qqgnvfscsv
251 mhealhnhyt qkslslspgk
```

FIG. 71

```
1   mdkthtcppc papellggps vflfppkpkd tlmisrtpev tcvvvdvshe
51  dpevkfnwyv dgvevhnakt kpreeqynst yrvvsvltvl hqdwlngkey
101 kckvsnkalp apiektiska kgqprepqvy tlppsrdelg grscidtipk
151 srctafqckh smkyrlsfcr ktcgtcggtk nqvsltclvk gfypsdiave
201 wesngqpenn ykttppvlds dgsfflyskl tvdksrwqqg nvfscsvmhe
251 alhnhytqks lslspgk
```

FIG. 72

```
1   mdkthtcppc papellggps vflfppkpkd tlmisrtpev tcvvvdvshe
51  dpevkfnwyv dgvevhnakt kpreeqynst yrvvsvltvl hqdwlngkey
101 kckvsnkalp apiektiska kgqprepqvy tlppsrdelg grscidtipk
151 srctafqckh smkyrlsfcr ktcgtcgggg tknqvsltcl vkgfypsdia
201 vewesngqpe nnykttppvl dsdgsfflys kltvdksrwq qgnvfscsvm
251 healhnhytq kslslspgk
```

FIG. 73

```
1   mdkthtcppc papellggps vflfppkpkd tlmisrtpev tcvvvdvshe
51  dpevkfnwyv dgvevhnakt kpreeqynst yrvvsvltvl hqdwlngkey
101 kckvsnkalp apiektiska kgqprepqvy tlppsrdelg ggggviinvk
151 ckisrqclep ckkagmrfgk cmngkchctp kggtknqvsl tclvkgfyps
201 diavewesng qpennykttp pvldsdgsff lyskltvdks rwqqgnvfsc
251 svmhealhnh ytqkslslsp gk
```

| # Name | Abs<260nm> | Abs<280nm> | Abs<340nm> |
|---|---|---|---|
| 1 15*shk-Fc | 0.18855 | 0.32489 | 1.7233E-3 |

| # Name | Abs<260nm> | Abs<280nm> | Abs<340nm> |
|---|---|---|---|
| 1 36*Met-shk-Fc | 6.3299E-2 | 0.10720 | 2.8033E-3 |

| | | IC50 (nM) | IC50 Transit (nM) | Cell No. |
|---|---|---|---|---|
| PX | CHO/Kv1.3 | 0.008 | 0.008 | 2 |
| | HEK/Kv1.1 | 0.434 | 0.644 | 7 |
| WCPC | CHO/Kv1.3 | 0.025 | 0.025 | 4 |
| | HEK/Kv1.1 | 0.440 | 1.110 | 3 |

Figure 89A-89E. NMR Structure of OSK1: some amino acid residues important for Kv1.3 activity (Fig. 89B) and analog sites that improve Kv1.3 selectivity relative to Kv1.1 (Fig. 89D).
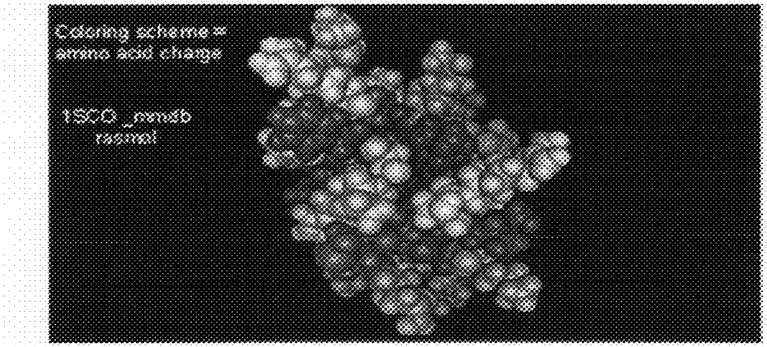
FIG. 89A
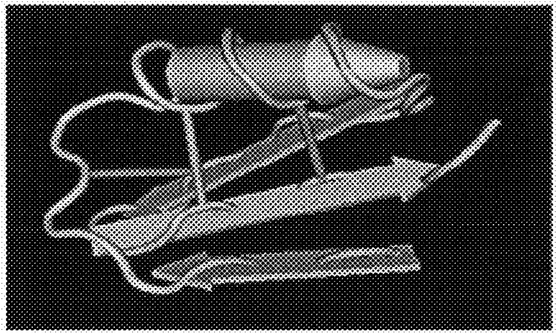
FIG. 89C
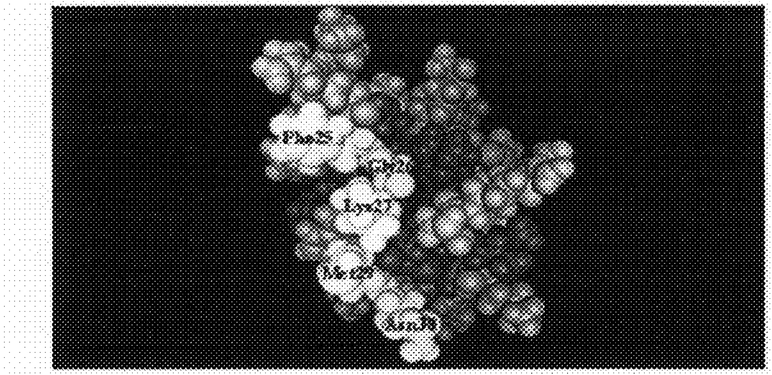
FIG. 89B
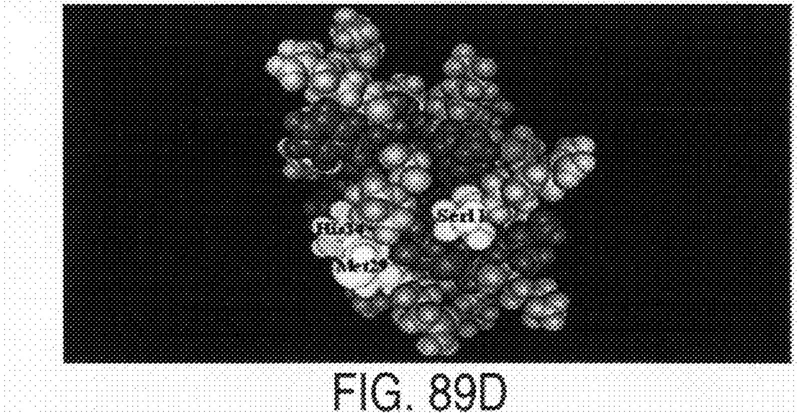
FIG. 89D
FIG. 89E
```
         10          20          30
GVIINVKCKI SRQCLEPCKK AGMRFGKCMN GKCHCTPK
  β1           α1           β2      β3
```

Cyclosporin A

ShK-Ala22

OSK1-Ala29

OSK1-Ala12

OSK1 PEPTIDE ANALOGS AND PHARMACEUTICAL COMPOSITIONS

This application claims priority from U.S. Provisional Application No. 60/854,674, filed Oct. 25, 2006, and U.S. Application No. 60/995,370, filed Sep. 25, 2007, both of which are hereby incorporated by reference.

This application is also related to U.S. Non-provisional application Ser. No. 11/584,177, filed Oct. 19, 2006, which claims priority from U.S. Provisional Application No. 60/729,083, filed Oct. 21, 2005, both of which applications are hereby incorporated by reference.

The instant application contains an ASCII "txt" compliant sequence listing submitted via EFS-WEB on Sep. 11, 2009, which serves as both the computer readable form (CRF) and the paper copy required by 37 C.F.R. Section 1.821(c) and 1.821(e), and is hereby incorporated by reference in its entirety. The name of the "txt" file created on Sep. 10, 2009, is: A-1186-US-NP2-RevSeqList091109.txt, and is 2,607 kB in size.

Throughout this application various publications are referenced within parentheses or brackets. The disclosures of these publications in their entireties are hereby incorporated by reference in this application in order to more fully describe the state of the art to which this invention pertains.

BACKGROUND OF THE INVENTION

1. Field of the Invention

The present invention is related to the biochemical arts, in particular to therapeutic peptides and conjugates.

2. Discussion of the Related Art

Ion channels are a diverse group of molecules that permit the exchange of small inorganic ions across membranes. All cells require ion channels for function, but this is especially so for excitable cells such as those present in the nervous system and the heart. The electrical signals orchestrated by ion channels control the thinking brain, the beating heart and the contracting muscle. Ion channels play a role in regulating cell volume, and they control a wide variety of signaling processes.

The ion channel family includes $Na^+$, $K^+$, and $Ca^{2+}$ cation and $Cl^-$ anion channels. Collectively, ion channels are distinguished as either ligand-gated or voltage-gated. Ligand-gated channels include both extracellular and intracellular ligand-gated channels. The extracellular ligand-gated channels include the nicotinic acetylcholine receptor (nAChR), the serotonin (5-hydroxytryptamine, 5-HT) receptors, the glycine and γ-butyric acid receptors (GABA) and the glutamate-activated channels including kanate, α-amino-3-hydroxy-5-methyl-4-isoxazole propionic acid (AMPA) and N-methyl-D-aspartate receptors (NMDA) receptors. (Harte and Ouzounis (2002), *FEBS Lett.* 514: 129-34). Intracellular ligand gated channels include those activated by cyclic nucleotides (e.g. cAMP, cGMP), $Ca^{2+}$ and G-proteins. (Harte and Ouzounis (2002), *FEBS Lett.* 514: 129-34). The voltage-gated ion channels are categorized by their selectivity for inorganic ion species, including sodium, potassium, calcium and chloride ion channels. (Harte and Ouzounis (2002), *FEBS Lett.* 514: 129-34).

A unified nomenclature for classification of voltage-gated channels was recently presented. (Catterall et al. (2000), *Pharmacol. Rev.* 55: 573-4; Gutman et al. (2000), *Pharmacol. Rev.* 55, 583-6; Catterall et al. (2000) *Pharmacol. Rev.* 55: 579-81; Catterall et al. (2000), *Pharmacol. Rev.* 55: 575-8; Hofmann et al. (2000), *Pharmacol. Rev.* 55: 587-9; Clapham et al. (2000), *Pharmacol Rev.* 55: 591-6; Chandy (1991), *Nature* 352: 26; Goldin et al. (2000), *Neuron* 28: 365-8; Ertel et al. (2000), *Neuron* 25: 533-5).

The $K^+$ channels constitute the largest and best characterized family of ion channels described to date. Potassium channels are subdivided into three general groups: the 6 transmembrane (6TM) $K^+$ channels, the 2TM-2TM/leak $K^+$ channels and the 2TM/$K^+$ inward rectifying channels. (Tang et al. (2004), *Ann. Rev. Physiol.* 66, 131-159). These three groups are further subdivided into families based on sequence similarity. The voltage-gated $K^+$ channels, including (Kv1-6, Kv8-9), EAG, KQT, and Slo (BKCa), are family members of the 6TM group. The 2TM-2TM group comprises TWIK, TREK, TASK, TRAAK, and THIK, whereas the 2TM/Kir group consists of Kir1-7. Two additional classes of ion channels include the inward rectifier potassium (IRK) and ATP-gated purinergic (P2X) channels. (Harte and Ouzounis (2002), *FEBS Lett.* 514: 129-34).

Toxin peptides produced by a variety of organisms have evolved to target ion channels. Snakes, scorpions, spiders, bees, snails and sea anemone are a few examples of organisms that produce venom that can serve as a rich source of small bioactive toxin peptides or "toxins" that potently and selectively target ion channels and receptors. In most cases, these toxin peptides have evolved as potent antagonists or inhibitors of ion channels, by binding to the channel pore and physically blocking the ion conduction pathway. In some other cases, as with some of the tarantula toxin peptides, the peptide is found to antagonize channel function by binding to a region outside the pore (e.g., the voltage sensor domain).

The toxin peptides are usually between about 20 and about 80 amino acids in length, contain 2-5 disulfide linkages and form a very compact structure (see, e.g., FIG. 10). Toxin peptides (e.g., from the venom of scorpions, sea anemones and cone snails) have been isolated and characterized for their impact on ion channels. Such peptides appear to have evolved from a relatively small number of structural frameworks that are particularly well suited to addressing the critical issues of potency and stability. The majority of scorpion and Conus toxin peptides, for example, contain 10-40 amino acids and up to five disulfide bonds, forming extremely compact and constrained structure (microproteins) often resistant to proteolysis. The conotoxin and scorpion toxin peptides can be divided into a number of superfamilies based on their disulfide connections and peptide folds. The solution structure of many of these has been determined by NMR spectroscopy, illustrating their compact structure and verifying conservation of their family fold. (E.g., Tudor et al., Ionisation behaviour and solution properties of the potassium-channel blocker ShK toxin, Eur. J. Biochem. 251(1-2):133-41 (1998); Pennington et al., Role of disulfide bonds in the structure and potassium channel blocking activity of ShK toxin, Biochem. 38(44): 14549-58 (1999); Jaravine et al., Three-dimensional structure of toxin OSK1 from *Orthochirus scrobiculosus* scorpion venom, Biochem. 36(6):1223-32 (1997); del Rio-Portillo et al.; NMR solution structure of Cn12, a novel peptide from the Mexican scorpion *Centruroides noxius* with a typical beta-toxin sequence but with alpha-like physiological activity, Eur. J. Biochem. 271(12): 2504-16 (2004); Prochnicka-Chalufour et al., Solution structure of discrepin, a new $K^+$-channel blocking peptide from the alpha-KTx15 subfamily, Biochem. 45(6):1795-1804 (2006)).

Conserved disulfide structures can also reflect the individual pharmacological activity of the toxin family. (Nicke et al. (2004), *Eur. J. Biochem.* 271: 2305-19, Table 1; Adams (1999), *Drug Develop. Res.* 46: 219-34). For example, α-conotoxins have well-defined four cysteine/two disulfide loop structures (Loughnan, 2004) and inhibit nicotinic acetylcholine receptors. In contrast, ω-conotoxins have six cysteine/three disulfide loop consensus structures (Nielsen, 2000) and block calcium channels. Structural subsets of toxins have evolved to inhibit either voltage-gated or calcium-activated potassium channels. FIG. 9 shows that a limited number of conserved disulfide architectures shared by a variety of venomous animals from bee to snail and scorpion to snake target ion channels. FIG. 7A-7B shows alignment of alpha-scorpion toxin family and illustrates that a conserved structural framework is used to derive toxins targeting a vast array of potassium channels.

Due to their potent and selective blockade of specific ion channels, toxin peptides have been used for many years as tools to investigate the pharmacology of ion channels. Other than excitable cells and tissues such as those present in heart, muscle and brain, ion channels are also important to non-excitable cells such as immune cells. Accordingly, the potential therapeutic utility of toxin peptides has been considered for treating various immune disorders, in particular by inhibition of potassium channels such as Kv1.3 and IKCa1 since these channels indirectly control calcium signaling pathway in lymphocytes. [e.g., Kem et al., ShK toxin compositions and methods of use, U.S. Pat. No. 6,077,680; Lebrun et al., Neuropeptides originating in scorpion, U.S. Pat. No. 6,689,749; Beeton et al., Targeting effector memory T cells with a selective peptide inhibitor of Kv1.3 channels for therapy of autoimmune diseases, Molec. Pharmacol. 67(4):1369-81 (2005); Mouhat et al., $K^+$ channel types targeted by synthetic OSK1, a toxin from *Orthochirus scrobiculosus* scorpion venom, Biochem. J. 385:95-104 (2005); Mouhat et al., Pharmacological profiling of *Orthochirus scrobiculosus* toxin 1 analogs with a trimmed N-terminal domain, *Molec. Pharmacol.* 69:354-62 (2006); Mouhat et al., OsK1 derivatives, WO 2006/002850 A2; B. S. Jensen et al. The $Ca^{2+}$-activated K+ Channel of Intermediate Conductance: A Molecular Target for Novel Treatments?, Current Drug Targets 2:401-422 (2001); Rauer et al., Structure-guided Transformation of Charybdotoxin Yields an Analog That Selectively Targets $Ca^{2+}$-activated over Voltage-gated $K^+$ Channels, J. Biol. Chem. 275: 1201-1208 (2000); Castle et al., Maurotoxin: A Potent Inhibitor of Intermediate Conductance $Ca^{2+}$-Activated Potassium Channels, Molecular Pharmacol. 63: 409-418 (2003); Chandy et al., $K^+$ channels as targets for specific Immunomodulation, Trends in Pharmacol. Sciences 25: 280-289 (2004); Lewis & Garcia, Therapeutic Potential of Venom Peptides, Nat. Rev. Drug Discov. 2: 790-802 (2003)].

Small molecules inhibitors of Kv1.3 and IKCa1 potassium channels and the major calcium entry channel in T cells, CRAC, have also been developed to treat immune disorders [A. Schmitz et al. (2005) Molecul. Pharmacol. 68, 1254; K. G. Chandy et al. (2004) TIPS 25, 280; H. Wulff et al. (2001) J. Biol. Chem. 276, 32040; C. Zitt et al. (2004) J. Biol. Chem. 279, 12427], but obtaining small molecules with selectivity toward some of these targets has been difficult.

Calcium mobilization in lymphocytes is known to be a critical pathway in activation of inflammatory responses [M. W. Winslow et al. (2003) Current Opinion Immunol. 15, 299]. Compared to other cells, T cells show a unique sensitivity to increased levels of intracellular calcium and ion channels both directly and indirectly control this process. Inositol triphosphate (IP3) is the natural second messenger which activates the calcium signaling pathway. IP3 is produced following ligand-induced activation of the T cell receptor (TCR) and upon binding to its intracellular receptor (a channel) causes unloading of intracellular calcium stores. The endoplasmic reticulum provides one key calcium store. Thapsigargin, an inhibitor of the sarcoplasmic-endoplasmic reticulum calcium ATPase (SERCA), also causes unloading of intracellular stores and activation of the calcium signaling pathway in lymphocytes. Therefore, thapsigargin can be used as a specific stimulus of the calcium signaling pathway in T cells. The unloading of intracellular calcium stores in T cells is known to cause activation of a calcium channel on the cell surface which allows for influx of calcium from outside the cell. This store operated calcium channel (SOCC) on T cells is referred to as "CRAC" (calcium release activated channel) and sustained influx of calcium through this channel is known to be critical for full T cell activation [S. Feske et al. (2005) J. Exp. Med. 202, 651 and N. Venkatesh et al. (2004) PNAS 101, 8969]. For many years it has been appreciated that in order to maintain continued calcium influx into T cells, the cell membrane must remain in a hyperpolarized condition through efflux of potassium ions. In T cells, potassium efflux is accomplished by the voltage-gated potassium channel Kv1.3 and the calcium-activated potassium channel IKCa1 [K. G. Chandy et al. (2004) TIPS 25, 280]. These potassium channels therefore indirectly control the calcium signaling pathway, by allowing for the necessary potassium efflux that allows for a sustained influx of calcium through CRAC.

Sustained increases in intracellular calcium activate a variety of pathways in T cells, including those leading to activation of NFAT, NF-kB and AP-1 [Quintana-A (2005) Pflugers Arch.—Eur. J. Physiol. 450, 1]. These events lead to various T cell responses including alteration of cell size and membrane organization, activation of cell surface effector molecules, cytokine production and proliferation. Several calcium sensing molecules transmit the calcium signal and orchestrate the cellular response. Calmodulin is one molecule that binds calcium, but many others have been identified (M. J. Berridge et al. (2003) Nat. Rev. Mol. Cell. Biol. 4, 517). The calcium-calmodulin dependent phosphatase calcineurin is activated upon sustained increases in intracellular calcium and dephosphorylates cytosolic NFAT. Dephosphorylated NFAT quickly translocates to the nucleus and is widely accepted as a critical transcription factor for T cell activation (F. Macian (2005) Nat. Rev. Immunol. 5, 472 and N. Venkatesh et al. (2004) PNAS 101, 8969). Inhibitors of calcineurin, such as cyclosporin A (Neoral, Sand immune) and FK506 (Tacrolimus) are a main stay for treatment of severe immune disorders such as those resulting in rejection following solid organ transplant (I. M. Gonzalez-Pinto et al. (2005) Transplant. Proc. 37, 1713 and D. R. J. Kuypers (2005) Transplant International 18, 140). Neoral has been approved for the treatment of transplant rejection, severe rheumatoid arthritis (D. E. Yocum et al. (2000) Rheumatol. 39, 156) and severe psoriasis (J. Koo (1998) British J. Dermatol. 139, 88). Preclinical and clinical data has also been provided suggesting calcineurin inhibitors may have utility in treatment of inflammatory bowel disease (IBD; Baumgart D C (2006) Am. J. Gastroenterol. March 30; Epub ahead of print), multiple sclerosis (Ann. Neurol. (1990) 27, 591) and asthma (S. Rohatagi et al. (2000) J. Clin. Pharmacol. 40, 1211). Lupus represents another disorder that may benefit from agents blocking activation of helper T cells. Despite the importance of calcineurin in regulating NFAT in T cells, calcineurin is also expressed in other tissues (e.g. kidney) and cyclosporine A & FK506 have a narrow safety margin due to mechanism based toxicity. Renal toxicity and hypertension are common side effects that have limited the promise of cyclosporine & FK506. Due to concerns regarding toxicity, calcineurin inhibitors are used mostly to treat only severe immune disease (Bissonnette-R et al. (2006) J. Am. Acad. Dermatol. 54, 472). Kv1.3 inhibitors offer a safer alternative to calcineurin inhibitors for the treatment of immune disorders. This is because Kv1.3 also operates to control the calcium signaling pathway in T cells, but does so through a distinct mechanism to that of calcineurin inhibitors, and evidence on Kv1.3 expression and function show that Kv1.3 has a more restricted role in T cell biology relative to calcineurin, which functions also in a variety of non-lymphoid cells and tissues.

Calcium mobilization in immune cells also activates production of the cytokines interleukin 2 (IL-2) and interferon gamma (IFNg) which are critical mediators of inflammation. IL-2 induces a variety of biological responses ranging from expansion and differentiation of $CD4^+$ and $CD8^+$ T cells, to enhancement of proliferation and antibody secretion by B cells, to activation of NK cells [S. L. Gaffen & K. D. Liu (2004) Cytokine 28, 109]. Secretion of IL-2 occurs quickly following T cell activation and T cells represent the predominant source of this cytokine. Shortly following activation, the high affinity IL-2 receptor (IL2-R) is upregulated on T cells endowing them with an ability to proliferate in response to IL-2. T cells, NK cells, B cells and professional antigen presenting cells (APCs) can all secrete IFNg upon activation. T cells represent the principle source of IFNg production in mediating adaptive immune responses, whereas natural killer (NK) cells & APCs are likely an important source during host defense against infection [K. Schroder et al. (2004) J. Leukoc. Biol. 75, 163]. IFNg, originally called macrophage-activating factor, upregulates antigen processing and presentation by monocytes, macrophages and dendritic cells. IFNg mediates a diverse array of biological activities in many cell types [U. Boehm et al. (1997) Annu. Rev. Immunol. 15, 749] including growth & differentiation, enhancement of NK cell activity and regulation of B cell immunoglobulin production and class switching.

CD40L is another cytokine expressed on activated T cells following calcium mobilization and upon binding to its receptor on B cells provides critical help allowing for B cell germinal center formation, B cell differentiation and antibody isotype switching. CD40L-mediated activation of CD40 on B cells can induce profound differentiation and clonal expansion of immunoglobulin (Ig) producing B cells [S. Quezada et al. (2004) Annu. Rev. Immunol. 22, 307]. The CD40 receptor can also be found on dendritic cells and CD40L signaling can mediate dendritic cell activation and differentiation as well. The antigen presenting capacity of B cells and dendritic cells is promoted by CD40L binding, further illustrating the broad role of this cytokine in adaptive immunity. Given the essential role of CD40 signaling to B cell biology, neutralizing antibodies to CD40L have been examined in preclinical and clinical studies for utility in treatment of systemic lupus erythematosis (SLE), —a disorder characterized by deposition of antibody complexes in tissues, inflammation and organ damage [J. Yazdany and J Davis (2004) Lupus 13, 377].

Production of toxin peptides is a complex process in venomous organisms, and is an even more complex process synthetically. Due to their conserved disulfide structures and need for efficient oxidative refolding, toxin peptides present challenges to synthesis. Although toxin peptides have been used for years as highly selective pharmacological inhibitors of ion channels, the high cost of synthesis and refolding of the toxin peptides and their short half-life in vivo have impeded the pursuit of these peptides as a therapeutic modality. Far more effort has been expended to identify small molecule inhibitors as therapeutic antagonists of ion channels, than has been given the toxin peptides themselves. One exception is the recent approval of the small ω-conotoxin MVIIA peptide (Ziconotide™) for treatment of intractable pain. The synthetic and refolding production process for Ziconotide™, however, is costly and only results in a small peptide product with a very short half-life in vivo (about 4 hours).

A cost-effective process for producing therapeutics, such as but not limited to, inhibitors of ion channels, is a desideratum provided by the present invention, which involves toxin peptides fused, or otherwise covalently conjugated to a vehicle.

SUMMARY OF THE INVENTION

The present invention relates to a composition of matter of the formula:

$$(X^1)_a—(F^1)_d—(X^2)_b—(F^2)_e—(X^3)_c \qquad (I)$$

and multimers thereof, wherein:

$F^1$ and $F^2$ are half-life extending moieties, and d and e are each independently 0 or 1, provided that at least one of d and e is 1;

$X^1$, $X^2$, and $X^3$ are each independently $-(L)_f-P-(L)_g-$, and f and g are each independently 0 or 1;

P is a toxin peptide of no more than about 80 amino acid residues in length, comprising at least two intrapeptide disulfide bonds, and at least one P is an OSK1 peptide analog;

L is an optional linker (present when f=1 and/or g=1); and a, b, and c are each independently 0 or 1, provided that at least one of a, b and c is 1.

The present invention thus concerns molecules having variations on Formula I, such as the formulae:

$$P-(L)_g-F^1 \text{ (i.e., b, c, and e equal to 0);} \qquad (II)$$

$$F^1-(L)_g-P \text{ (i.e., a, c, and e equal to 0);} \qquad (III)$$

$$P-(L)_g-F^1-(L)_f-P \text{ or } (X^1)_a—F^1—(X^2)_b \text{ (i.e., c and e equal to 0);} \qquad (IV)$$

$$F^1-(L)_f-P-(L)_g-F^2 \text{ (i.e., a and c equal to 0);} \qquad (V)$$

$$F^1-(L)_f-P-(L)_g-F^2-(L)_f-P \text{ (i.e., a equal to 0);} \qquad (VI)$$

$$F^1—F^2-(L)_f-P \text{ (i.e., a and b equal to 0);} \qquad (VII)$$

$$P-(L)_g-F^1—F^2 \text{ (i.e., b and c equal to 0);} \qquad (VIII)$$

$$P-(L)_g-F^1—F^2-(L)_f-P \text{ (i.e., b equal to 0);} \qquad (IX)$$

and any multimers of any of these, when stated conventionally with the N-terminus of the peptide(s) on the left. All of such molecules of Formulae II-IX are within the meaning of Structural Formula I. Within the meaning of Formula I, the toxin peptide (P), if more than one is present, can be independently the same or different from the OSK1 peptide analog, or any other toxin peptide(s) also present in the inventive composition, and the linker moiety ($(L)_f$ and/or $(L)_g$), if present, can be independently the same or different from any other linker, or linkers, that may be present in the inventive composition. Conjugation of the toxin peptide(s) to the half-life extending moiety, or moieties, can be via the N-terminal and/or C-terminal of the toxin peptide, or can be intercalary as to its primary amino acid sequence, $F^1$ being linked closer to the toxin peptide's N-terminus than is linked $F^2$. Examples of useful half-life extending moieties ($F^1$ or $F^2$) include immunoglobulin Fc domain (e.g., a human immunoglobulin Fc domain, including Fc of IgG1, IgG2, IgG3 or IgG4) or a portion thereof, human serum albumin (HSA), or poly(ethylene glycol) (PEG). These and other half-life extending moieties described herein are useful, either individually or in combination. A monovalent dimeric Fc-toxin peptide fusion (as represented schematically in FIG. 2B), for example, an Fc-OSK1 peptide analog fusion or Fc-ShK peptide analog fusion, is an example of the inventive composition of matter encompassed by Formula VII above.

The present invention also relates to a composition of matter, which includes, conjugated or unconjugated, a toxin peptide analog of ShK, OSK1, ChTx, or Maurotoxin modified from the native sequences at one or more amino acid residues, having greater Kv1.3 or IKCa1 antagonist activity, and/or target selectivity, compared to a ShK, OSK1, or Maurotoxin (MTX) peptides having a native sequence. The toxin peptide analogs comprise an amino acid sequence selected from any of the following:

SEQ ID NOS: 88, 89, 92, 148 through 200, 548 through 561, 884 through 949, or 1295 through 1300 as set forth in Table 2; or SEQ ID NOS: 980 through 1274, 1303, or 1308 as set forth in Table 7; or any of SEQ ID NOS: 1391 through 4912, 4916, 4920 through 5006, 5009, 5010, and 5012 through 5015 as set forth in Table 7A, Table 7B, Table 7C, Table 7D, Table 7E, Table 7F, Table 7G, Table 7H, Table 7I or Table 7J.

SEQ ID NOS: 330 through 337, 341, 1301, 1302, 1304 through 1307, 1309, 1311, 1312, and 1315 through 1336 as set forth in Table 13; or SEQ ID NOS: 36, 59, 344-346, or 1369 through 1390 as set forth in Table 14.

The present invention also relates to other toxin peptide analogs that comprise an amino acid sequence selected from, or comprise the amino acid primary sequence of, any of the following:

SEQ ID NOS: 201 through 225 as set forth in Table 3; or

SEQ ID NOS: 242 through 248 or 250 through 260 as set forth in Table 4; or

SEQ ID NOS: 261 through 275 as set forth in Table 5; or

SEQ ID NOS: 276 through 293 as set forth in Table 6; or

SEQ ID NOS: 299 through 315 as set forth in Table 8; or

SEQ ID NOS: 316 through 318 as set forth in Table 9; or

SEQ ID NO: 319 as set forth in Table 10; or

SEQ ID NO: 327 or 328 as set forth in Table 11; or

SEQ ID NOS: 330 through 337, 341, 1301, 1302, 1304 through 1307, 1309, 1311, 1312, or 1315 through 1336 as set forth in Table 13;

SEQ ID NOS: 1369 through 1390 as set forth in Table 14; or

SEQ ID NOS: 348 through 353 as set forth in Table 16; or

SEQ ID NOS: 357 through 362, 364 through 368, 370, 372 through 385, or 387 through 398 as set forth in Table 19; or SEQ ID NOS: 399 through 408 as set forth in Table 20; or SEQ ID NOS: 410 through 421 as set forth in Table 22; or SEQ ID NOS: 422, 424, 426, or 428 as set forth in Table 23; or SEQ ID NOS: 430 through 437 as set forth in Table 24; or SEQ ID NOS: 438 through 445 as set forth in Table 25; or SEQ ID NOS: 447, 449, 451, 453, 455, or 457 as set forth in Table 26; or SEQ ID NOS: 470 through 482 or 484 through 493 as set forth in Table 28; or SEQ ID NOS: 495 through 506 as set forth in Table 29; or SEQ ID NOS: 507 through 518 as set forth in Table 30.

The present invention is also directed to a pharmaceutical composition that includes the inventive composition of matter and a pharmaceutically acceptable carrier.

The compositions of this invention can be prepared by conventional synthetic methods, recombinant DNA techniques, or any other methods of preparing peptides and fusion proteins well known in the art. Compositions of this invention that have non-peptide portions can be synthesized by conventional organic chemistry reactions, in addition to conventional peptide chemistry reactions when applicable. Thus the present invention also relates to DNAs encoding the inventive compositions and expression vectors and host cells for recombinant expression.

The primary use contemplated is as therapeutic and/or prophylactic agents. The inventive compositions incorporating the toxin peptide can have activity and/or ion channel target selectivity comparable to—or even greater than—the unconjugated peptide.

Accordingly, the present invention includes a method of treating an autoimmune disorder, which involves administering to a patient who has been diagnosed with an autoimmune disorder, such as multiple sclerosis, type 1 diabetes, psoriasis, inflammatory bowel disease (IBD, including Crohn's Disease and ulcerative colitis), contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, a therapeutically effective amount of the inventive composition of matter (preferably comprising a Kv1.3 antagonist peptide or IKCa1 antagonist peptide), whereby at least one symptom of the disorder is alleviated in the patient. In addition, the present invention also relates to the use of one or more of the inventive compositions of matter in the manufacture of a medicament for the treatment or prevention of an autoimmune disorder, such as, but not limited to, any of the above-listed autoimmune disorders, e.g. multiple sclerosis, type 1 diabetes or IBD.

The present invention is further directed to a method of preventing or mitigating a relapse of a symptom of multiple sclerosis, which method involves administering to a patient, who has previously experienced at least one symptom of multiple sclerosis, a prophylactically effective amount of the inventive composition of matter (preferably comprising a Kv1.3 antagonist peptide or IKCa1 antagonist peptide), such that the at least one symptom of multiple sclerosis is prevented from recurring or is mitigated.

Although mostly contemplated as therapeutic agents, compositions of this invention can also be useful in screening for therapeutic or diagnostic agents. For example, one can use an Fc-peptide in an assay employing anti-Fc coated plates. The half-life extending moiety, such as Fc, can make insoluble peptides soluble and thus useful in a number of assays.

Numerous additional aspects and advantages of the present invention will become apparent upon consideration of the figures and detailed description of the invention.

U.S. Nonprovisional patent application Ser. No. 11/406,454, filed Apr. 17, 2006, is hereby incorporated by reference in its entirety.

BRIEF DESCRIPTION OF THE FIGURES

FIG. 1 shows schematic structures of some exemplary Fc dimers that can be derived from an IgG1 antibody. "Fc" in the figure represents any of the Fc variants within the meaning of "Fc domain" herein. "X1" and "X2" represent peptides or linker-peptide combinations as defined hereinafter. The specific dimers are as follows:

FIG. 2A shows a single chain molecule and can also represent the DNA construct for the molecule. FIG. 2B shows a dimer in which the linker-peptide portion is present on only one chain of the dimer (i.e., a "monovalent" dimer). FIG. 2C shows a dimer having the peptide portion on both chains. The dimer of FIG. 2C will form spontaneously in certain host cells upon expression of a DNA construct encoding the single chain shown in FIG. 2A. In other host cells, the cells could be placed in conditions favoring formation of dimers or the dimers can be formed in vitro.

FIG. 3A-3B shows exemplary nucleic acid and amino acid sequences (SEQ ID NOS: 1 and 2, respectively) of human IgG1 Fc that is optimized for mammalian expression and can be used in this invention.

FIG. 4A-4B shows exemplary nucleic acid and amino acid sequences (SEQ ID NOS: 3 and 4, respectively) of human IgG1 Fc that is optimized for bacterial expression and can be used in this invention.

FIG. 6 shows an alignment of the voltage-gated potassium channel inhibitor *Stichodactyla helianthus* (ShK) with other closely related members of the sea anemone toxin family. The sequence of the 35 amino acid mature ShK toxin (Accession #P29187) isolated from the venom of *Stichodactyla helianthus* is shown aligned to other closely related members of the sea anemone family. The consensus sequence and predicted disulfide linkages are shown, with highly conserved residues being shaded. The HmK peptide toxin sequence shown (Swiss-Protein Accession #097436) is of the immature precursor from the Magnificent sea anemone (*Radianthus magnifica; Heteractis maqnifica*) and the putative signal peptide is underlined. The mature HmK peptide toxin would be predicted to be 35 amino acids in length and span residues 40 through 74. AeK is the mature peptide toxin, isolated from the venom of the sea anemone *Actinia equine* (Accession #P81897). The sequence of the mature peptide toxin AsKS (Accession #Q9TWG1) and BgK (Accession #P29186) isolated from the venom of the sea anemone *Anemonia sulcata* and *Bunodosoma granulifera*, respectively, are also shown. FIG. 6A shows the amino acid alignment (SEQ ID NO: 10) of ShK to other members of the sea anemone family of toxins, HmK (SEQ ID NO: 6 (Mature Peptide), (SEQ ID NO: 542, Signal and Mature Peptide portions)), AeK (SEQ ID NO: 7), AsKs (SEQ ID NO: 8), and BgK (SEQ ID NO: 9). The predicted disulfide linkages are shown and conserved residues are highlighted. (HmK, SEQ ID NO: 543; ShK, SEQ ID NO: 10; AeK, SEQ ID NO: 544; AsKS, SEQ ID NO: 545). FIG. 6B shows a disulfide linkage map for this family having 3 disulfide linkages (C1-C6, C2-C4, C3-C5).

FIG. 7A-7B shows an amino acid alignment of the alpha-scorpion toxin family of potassium channel inhibitors. (BmKK1, SEQ ID NO: 11; BmKK4, SEQ ID NO: 12; PBTx1, SEQ ID NO: 14; Tc32, SEQ ID NO: 13; BmKK6, SEQ ID NO: 15; P01, SEQ ID NO: 16; Pi2, SEQ ID NO: 17; Pi3, SEQ ID NO: 18; Pi4, SEQ ID NO: 19; MTX, SEQ ID NO: 20; Pi1, SEQ ID NO: 21; HsTx1, SEQ ID NO: 61; AgTx2, SEQ ID NO: 23; KTX1, SEQ ID NO: 24; OSK1, SEQ ID NO: 25; BmKTX, SEQ ID NO: 22; HgTX1, SEQ ID NO: 27; MgTx, SEQ ID NO: 28; C11Tx1, SEQ ID NO: 29; NTX, SEQ ID NO: 30; Tc30, SEQ ID NO: 31; TsTX-Ka, SEQ ID NO: 32; PBTx3, SEQ ID NO: 33; Lqh 15-1, SEQ ID NO: 34; MartenTx, SEQ ID NO: 37; ChTx, SEQ ID NO:36; ChTx-Lq2, SEQ ID NO: 42; IbTx, SEQ ID NO: 38; SloTx, SEQ ID NO: 39; BmTx1; SEQ ID NO: 43; BuTx, SEQ ID NO: 41; AmmTx3, SEQ ID NO: 44; AaTX1, SEQ ID NO: 45; BmTX3, SEQ ID NO: 46; Tc1, SEQ ID NO: 48; OSK2, SEQ ID NO: 49; TsK, SEQ ID NO: 54; CoTx1, SEQ ID NO:55; CoTx2, SEQ ID NO: 871; BmPo5, SEQ ID NO: 60; ScyTx, SEQ ID NO: 51; P05, SEQ ID NO: 52; Tamapin, SEQ ID NO: 53; and TmTx, SEQ ID NO: 691. Highly conserved residues are shaded and a consensus sequence is listed. Subfamilies of the α-KTx are listed and are from Rodriguez de la Vega, R. C. et al. (2003) *TIPS* 24: 222-227. A list of some ion channels reported to antagonized is listed (IK=IKCa, BK=BKCa, SK=SKCa, Kv=voltage-gated K+ channels). Although most family members in this alignment represent the mature peptide product, several represent immature or modified forms of the peptide and these include: BmKK1, BmKK4, BmKK6, BmKTX, MartenTx, ChTx, ChTx-Lq2, BmTx1, AaTx1, BmTX3, TsK, CoTx1, BmP05.

FIG. 8 shows an alignment of toxin peptides converted to peptibodies in this invention (Apamin, SEQ ID NO: 68; HaTx1, SEQ ID NO: 494; ProTx1, SEQ ID NO: 56; PaTx2, SEQ ID NO: 57; ShK[2-35], SEQ ID NO: 92; ShK[1-35], SEQ ID NO: 5; HmK, SEQ ID NO: 6; ChTx (K32E), SEQ ID NO: 59; ChTx, SEQ ID NO: 36; IbTx, SEQ ID NO: 38; OSK1 (E16K, K20D), SEQ ID NO: 296; OSK1, SEQ ID NO: 25; AgTx2, SEQ ID NO: 23; KTX1, SEQ ID NO: 24; MgTx, SEQ ID NO: 28; NTX, SEQ ID NO: 30; MTX, SEQ ID NO: 20; Pi2, SEQ ID NO: 17; HsTx1, SEQ ID NO: 61; Anuroctoxin [AnTx], SEQ ID NO: 62; BeKm1, SEQ ID NO: 63; ScyTx, SEQ ID NO: 51; ωGVIA, SEQ ID NO: 64; ωMVIIa, SEQ ID NO: 65; Ptu1, SEQ ID NO: 66; and CTX, SEQ ID NO: 67). The original sources of the toxins is indicated, as well as, the number of cysteines in each. Key ion channels targeted are listed. The alignment shows clustering of toxin peptides based on their source and ion channel target impact.

FIG. 9 shows disulfide arrangements within the toxin family. The number of disulfides and the disulfide bonding order for each subfamily is indicated. A partial list of toxins that fall within each disulfide linkage category is presented.

FIG. 11A-C shows the nucleic acid (SEQ ID NO: 69 and SEQ ID NO: 1358) and encoded amino acid (SEQ ID NO:70, SEQ ID NO:1359 and SEQ ID NO: 1360) sequences of residues 5131-6660 of pAMG21ampR-Fc-pep. The sequences of the Fc domain (SEQ ID NOS: 71 and 72) exclude the five C-terminal glycine residues. This vector enables production of peptibodies in which the peptide-linker portion is at the C-terminus of the Fc domain.

FIG. 12A-C shows the nucleic acid (SEQ ID NO: 73 and SEQ ID NO: 1361) and encoded amino acid (SEQ ID NO:74, SEQ ID NO: 1362 and SEQ ID NO: 1363) sequences of residues 5131-6319 of pAMG21ampR-Pep-Fc. The sequences of the Fc domain (SEQ ID NOS: 75 and 76) exclude the five N-terminal glycine residues. This vector enables production of peptibodies in which the peptide-linker portion is at the N-terminus of the Fc domain.

FIG. 12E-G shows the nucleic acid (SEQ ID NO:1339) and encoded amino acid sequences of pAMG21ampR-Pep-Fc (SEQ ID NO:1340, SEQ ID NO:1341, and SEQ ID NO:1342). The sequences of the Fc domain (SEQ ID NOS: 75 and 76) exclude the five N-terminal glycine residues. This vector enables production of peptibodies in which the peptide-linker portion is at the N-terminus of the Fc domain.

FIG. 14A-14B shows the nucleotide and encoded amino acid sequences (SEQ. ID. NOS: 77 and 78, respectively) of the molecule identified as "Fc-L10-ShK[1-35]" in Example 1 hereinafter. The L10 linker amino acid sequence (SEQ ID NO: 79) is underlined.

FIG. 15A-15B shows the nucleotide and encoded amino acid sequences (SEQ. ID. NOS: 80 and 81, respectively) of the molecule identified as "Fc-L10-ShK[2-35]" in Example 2 hereinafter. The same L10 linker amino acid sequence (SEQ ID NO: 79) as used in Fc-L10-ShK[1-35] (FIG. 14A-14B) is underlined.

FIG. 16A-16B shows the nucleotide and encoded amino acid sequences (SEQ. ID. NOS: 82 and 83, respectively) of the molecule identified as "Fc-L25-ShK[2-35]" in Example 2 hereinafter. The L25 linker amino acid sequence (SEQ ID NO: 84) is underlined.

Figure 29A:
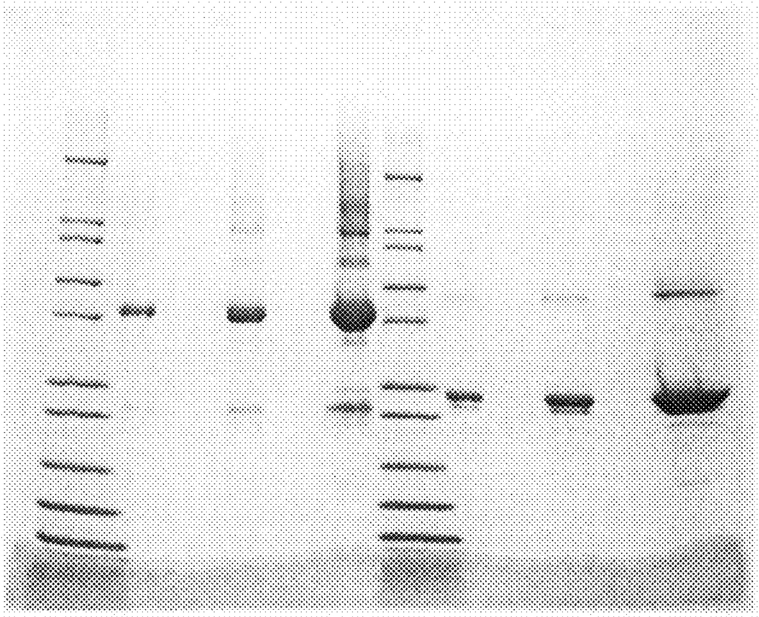
FIG. 29A shows a Coomassie brilliant blue stained tris-glycine 4-20% SDS-PAGE of Fc-L-AgTx2 purified and refolded from bacterial cells. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 29B:
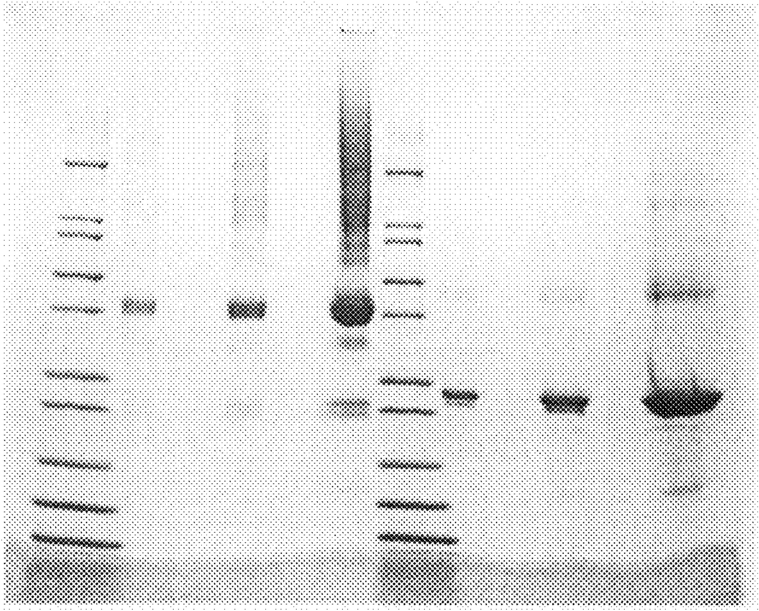
FIG. 29B shows a Coomassie brilliant blue stained tris-glycine 4-20% SDS-PAGE of Fc-L10-HaTx1 purified and refolded from bacterial cells. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced, spectral scan of the purified material.
Figure 29C:
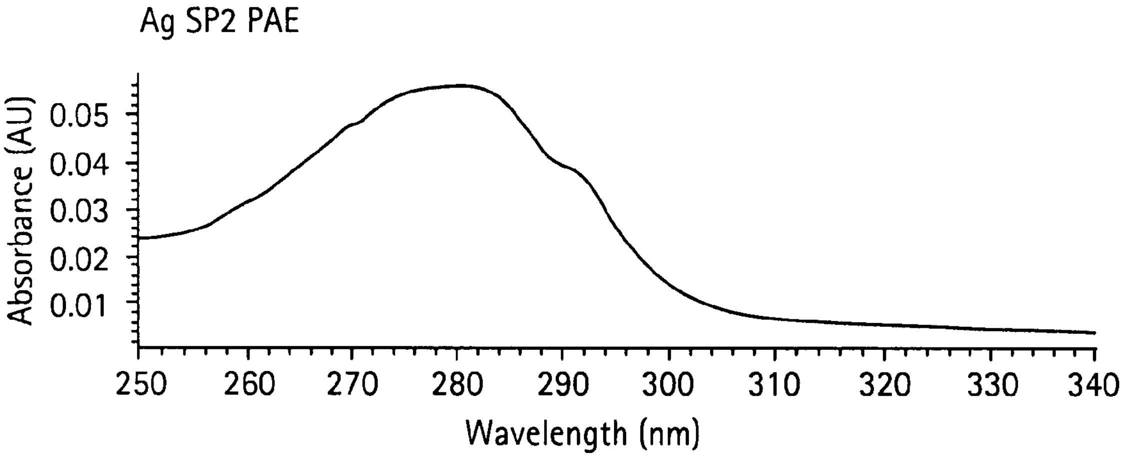
FIG. 29C shows a Spectral scan of 20 μl of the Fc-L110-AgTx2 product diluted in 700 μl PBS (blanking buffer) using a Hewlett Packard 8453 spectrophotometer and a 1 cm path length quartz cuvette.
Figure 29D:
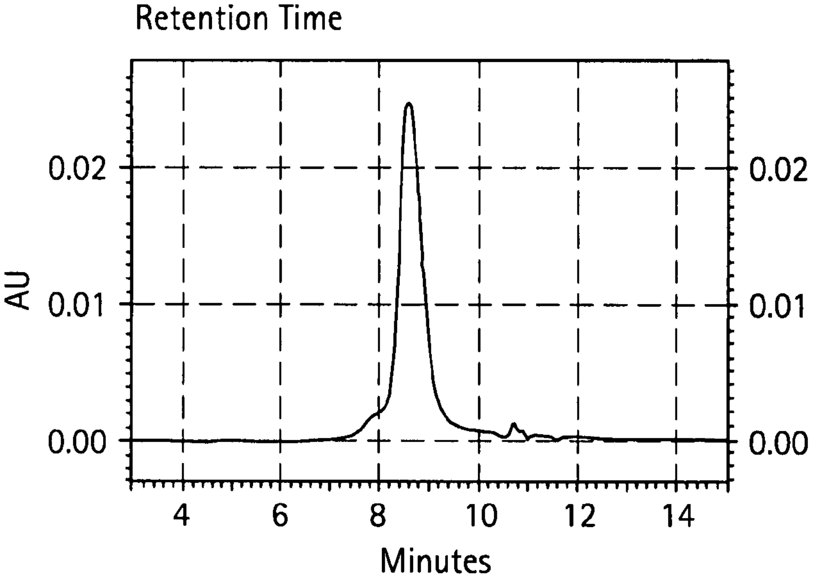
FIG. 29D shows the Size exclusion chromatography on 20 μg of the final Fc-L10-AgTx2 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.
Figure 29E:
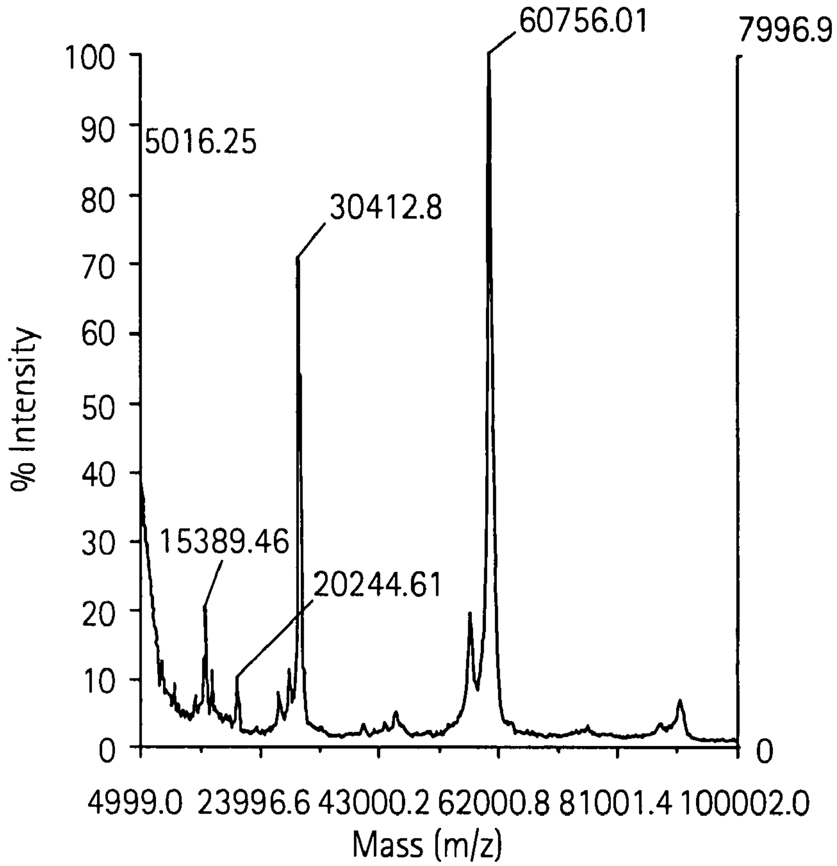
FIG. 29E shows a MALDI mass spectral analysis of the final sample of Fc-L10-AgTx2 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.
Figure 29F:
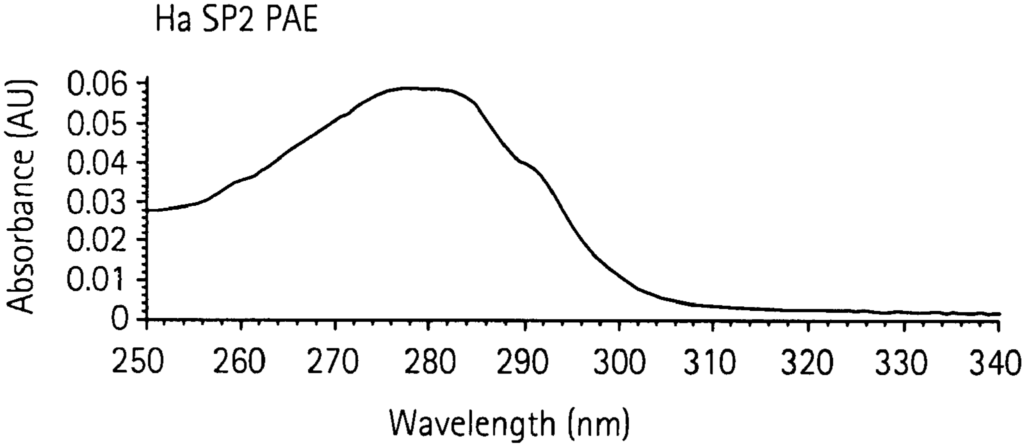

FIG. 29F shows a Spectral scan of 20 μl of the Fc-L10-HaTx1 product diluted in 700 μl PBS (blanking buffer) using a Hewlett Packard 8453 spectrophotometer and a 1 cm path length quartz cuvette.

Figure 29G:
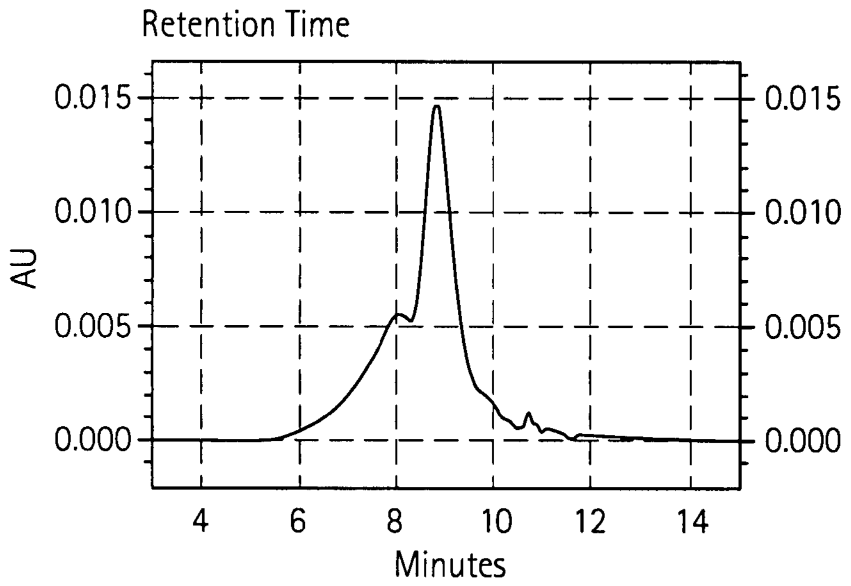

FIG. 29G shows the size exclusion chromatography on 20 μg of the final Fc-L10-HaTx1 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 29H:
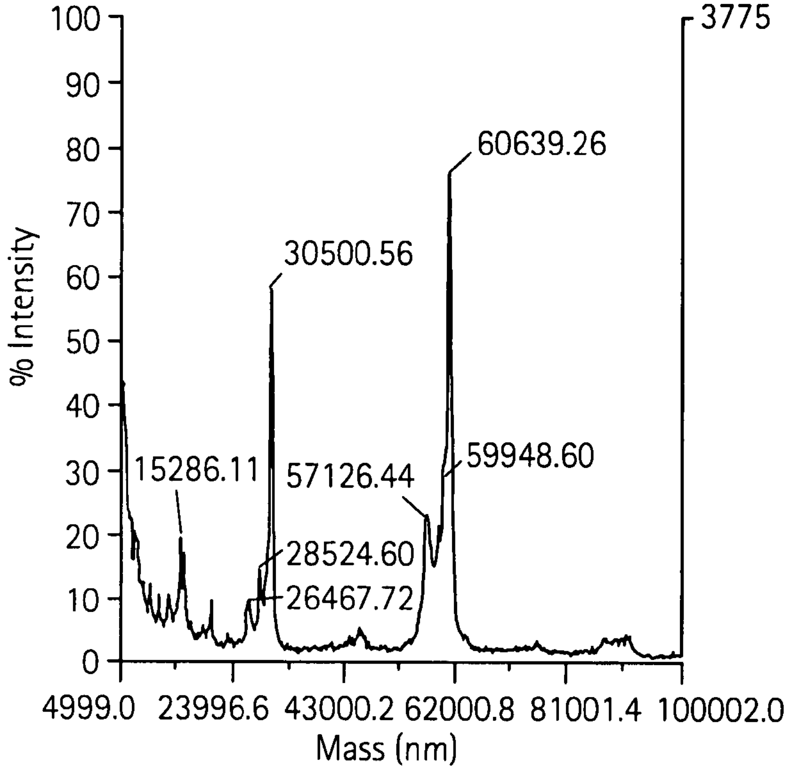

FIG. 29H shows a MALDI mass spectral analysis of the final sample of Fc-L10-HaTx1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 30A:
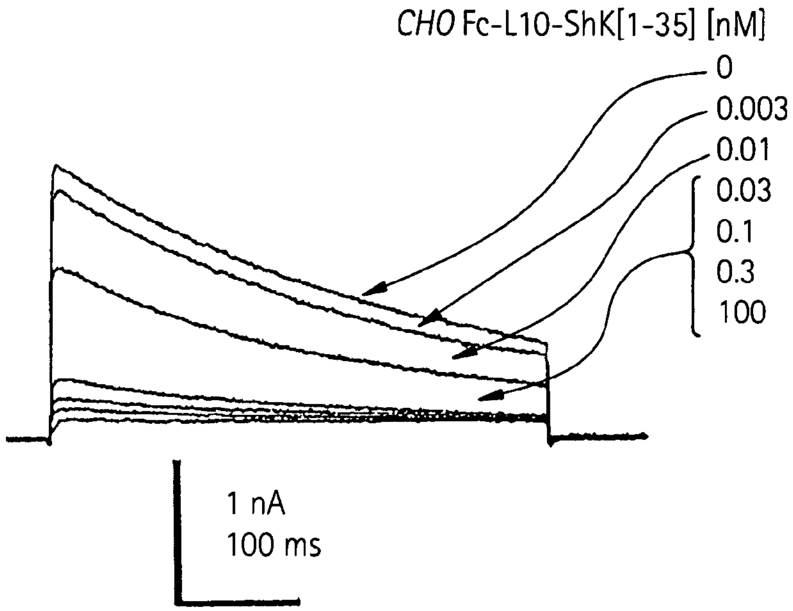

FIG. 30A shows Fc-L10-ShK[1-35] purified from CHO cells produces a concentration dependent block of the outward potassium current recorded from HEK293 cell stably expressing the human Kv1.3 channel.

Figure 30B:
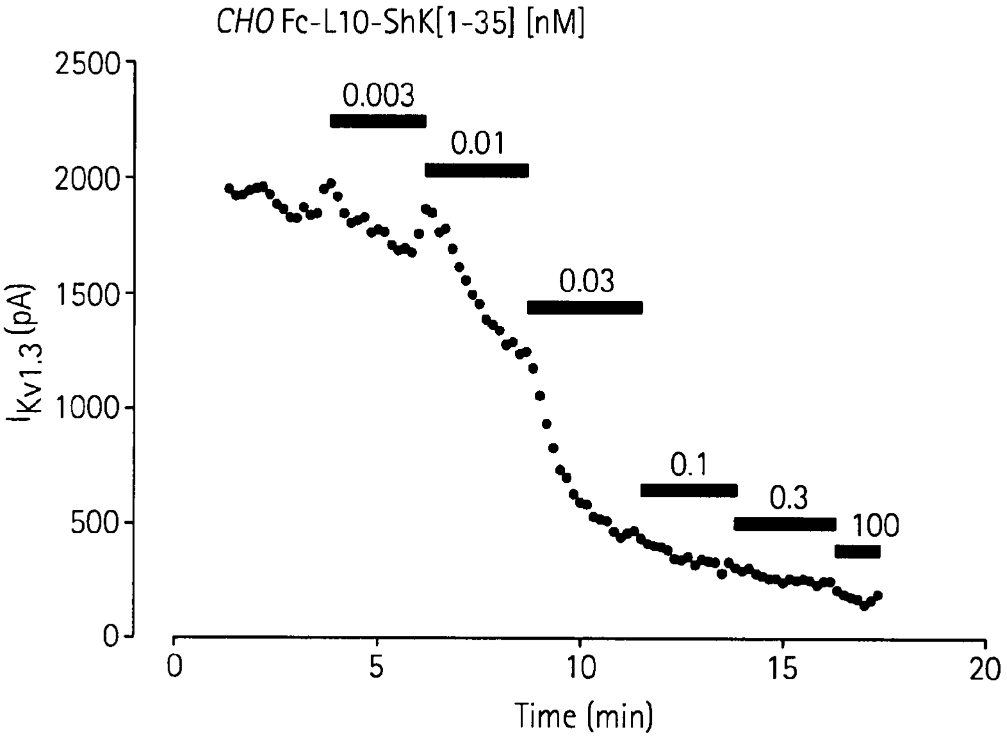

FIG. 30B shows the time course of potassium current block by Fc-L10-ShK[1-35] at various concentrations. The $IC_{50}$ was estimated to be 15±2 pM (n=4 cells).

Figure 30C:
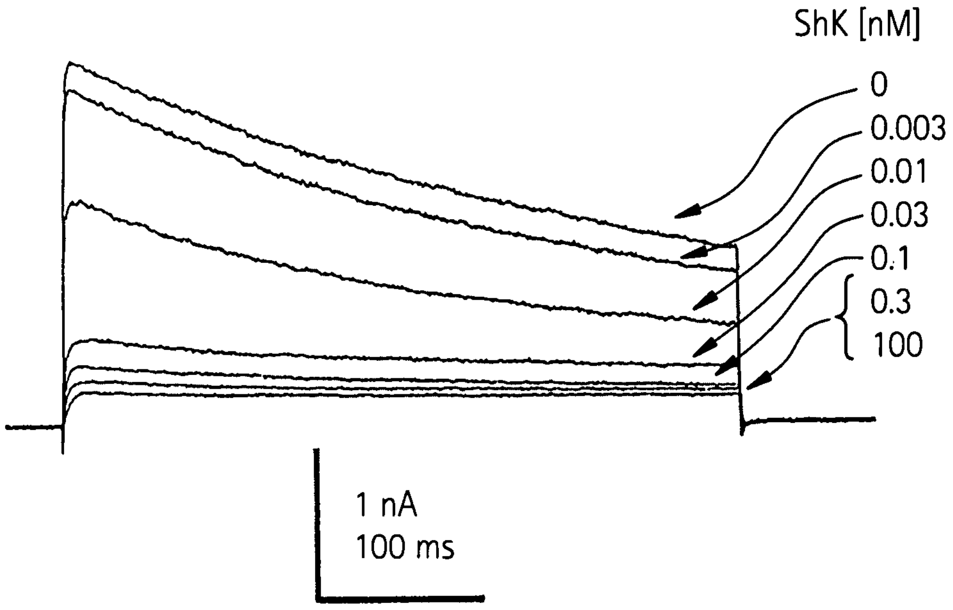

FIG. 30C shows synthetic ShK[1-35] (also referred to as "ShK" alone) produces a concentration dependent block of the outward potassium current recorded from HEK293 cell stably expressing human Kv1.3 channel.

Figure 30D:
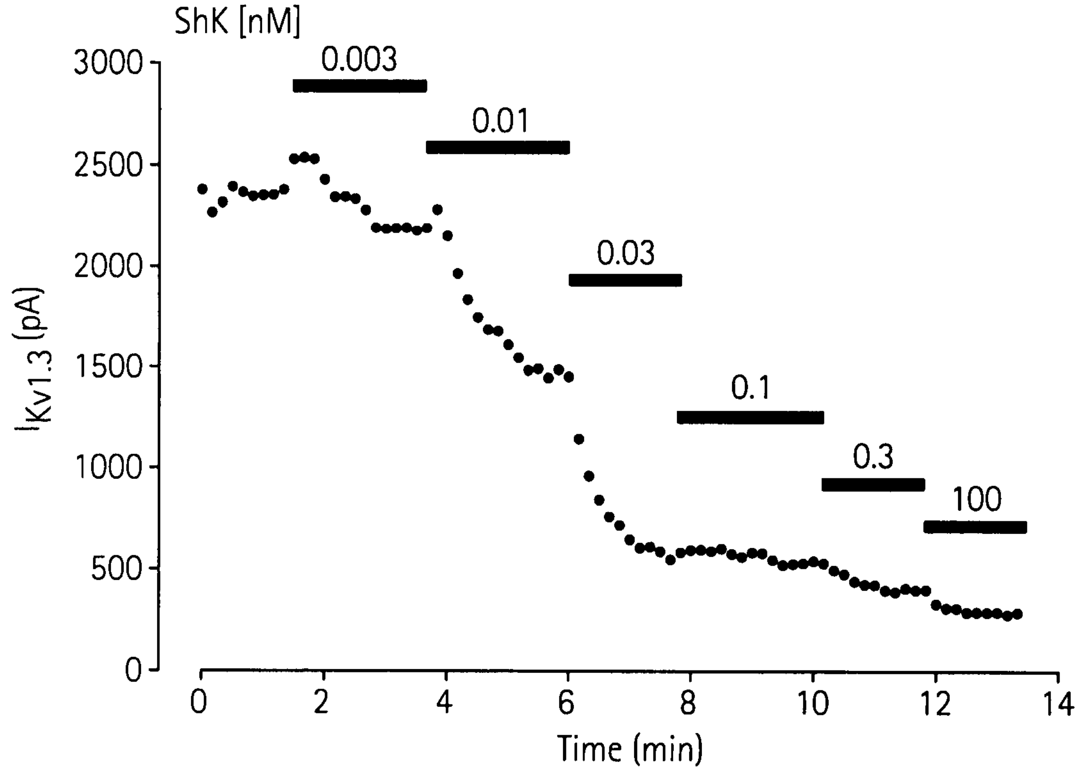

FIG. 30D shows the time course of ShK[1-35] block at various concentrations. The $IC_{50}$ for ShK was estimated to be 12±1 pM (n=4 cells).

Figure 31A:
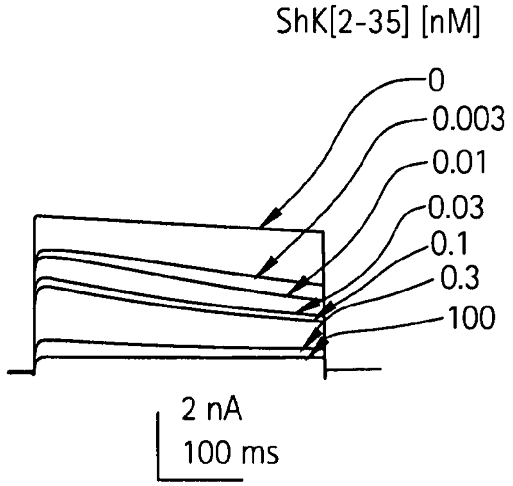

FIG. 31A shows synthetic peptide analog ShK[2-35] producing a concentration dependent block of the outward potassium current as recorded from HEK293 cells stably expressing human Kv1.3 channel with an IC50 of 49±5 pM (n=3 cells).

Figure 31B:
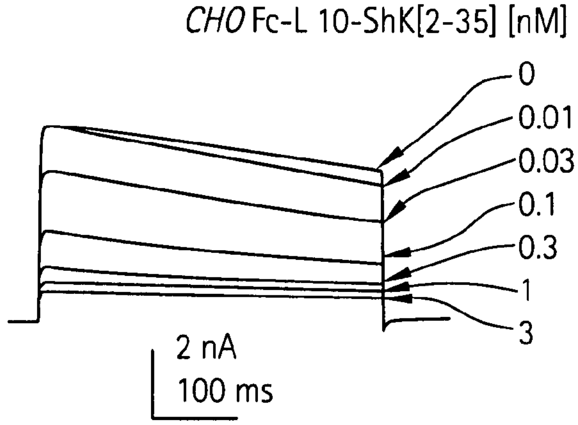

FIG. 31B shows the CHO-derived Fc-L10-ShK[2-35] peptibody producing a concentration dependent block of the outward potassium current as recorded from HEK293 cell stably expressing human Kv1.3 channel with an IC50 of 115±18 pM (n=3 cells).

Figure 31C:
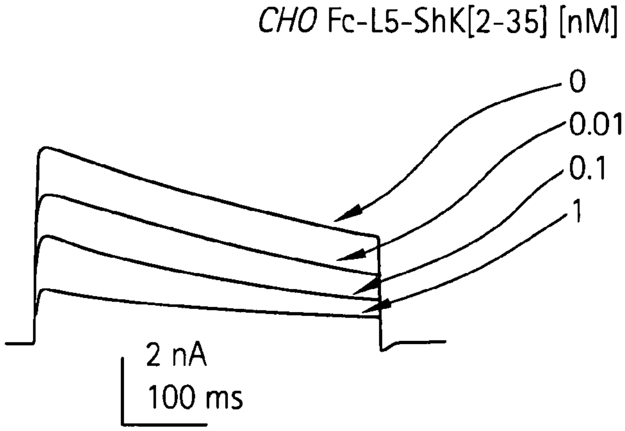

FIG. 31C shows the Fc-L5-ShK[2-35] peptibody produces a concentration dependent block of the outward potassium current recorded from HEK293 cell stably expressing human Kv1.3 channel with an IC50 of 100 pM (n=3 cells).

Figure 32A:
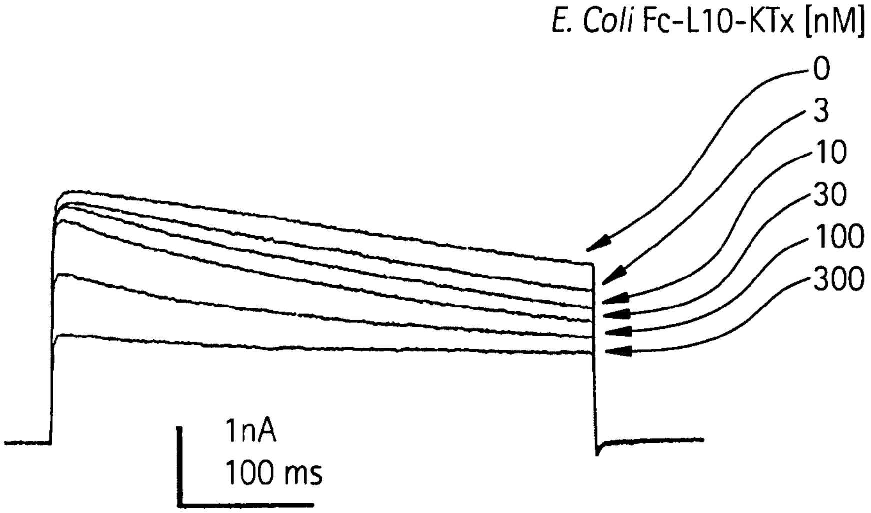

FIG. 32A shows Fc-L-KTX1 peptibody purified from bacterial cells producing a concentration dependent block of the outward potassium current as recorded from HEK293 cell stably expressing human Kv1.3 channel.

Figure 32B:
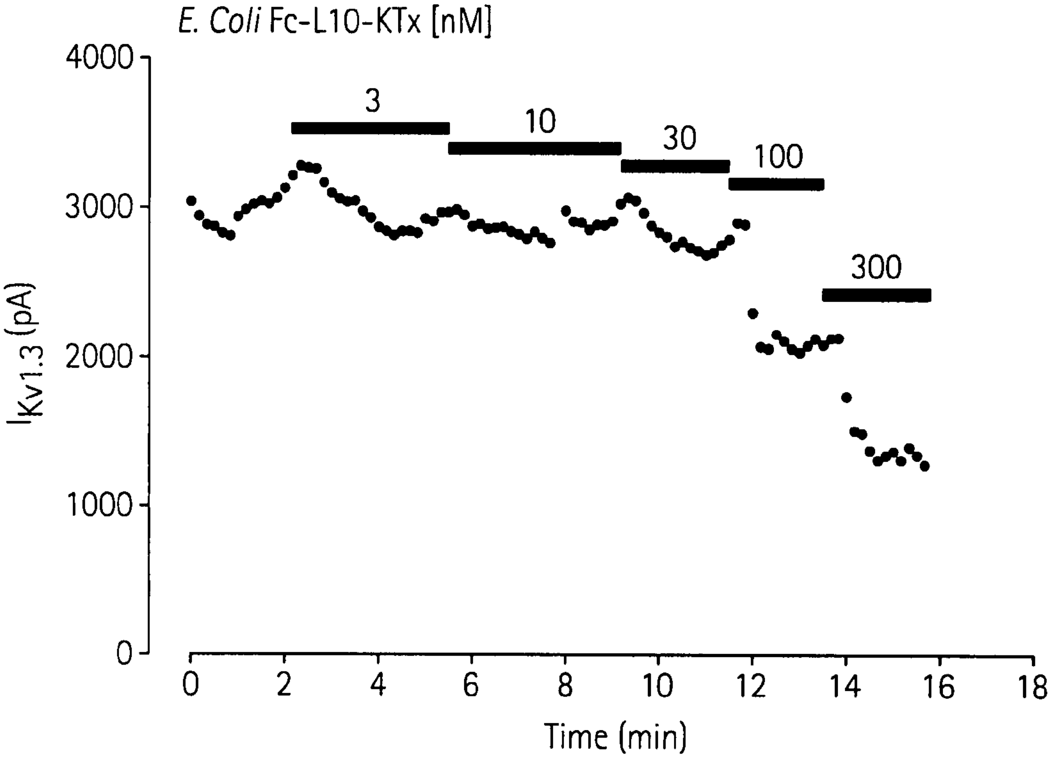

FIG. 32B shows the time course of potassium current block by Fc-L10-KTX1 at various concentrations.

Figure 33A:
Figure 33B:
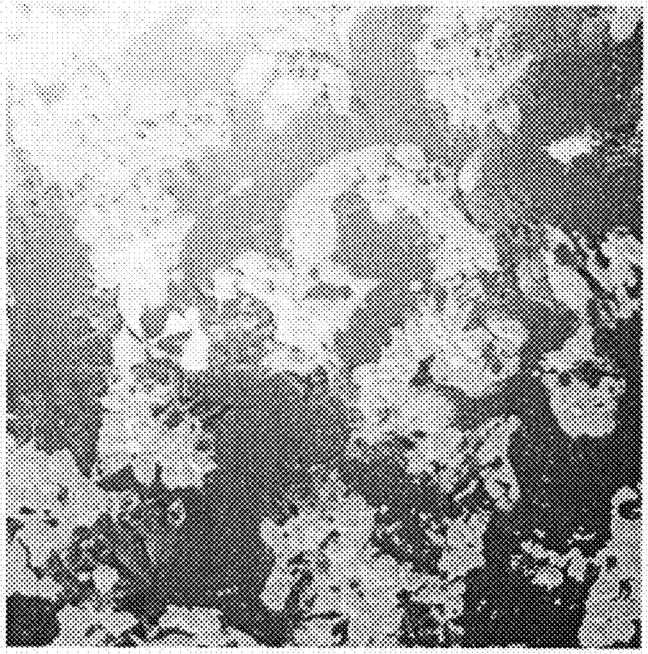

FIG. 33 shows by immunohistochemistry that CHO-derived Fc-L10-ShK[1-35] peptibody stains HEK 293 cells stably transfected with human Kv1.3 (FIG. 33A), whereas untransfected HEK 293 cells are not stained with the peptibody (FIG. 33B).

Figure 34A:
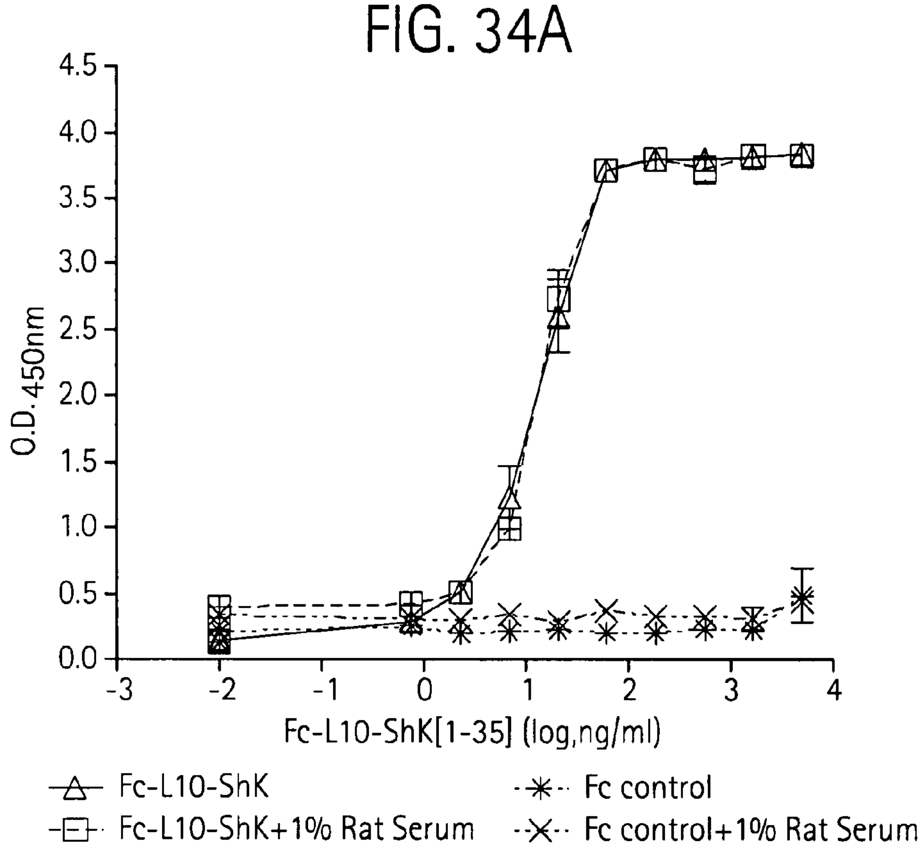
Figure 34B:
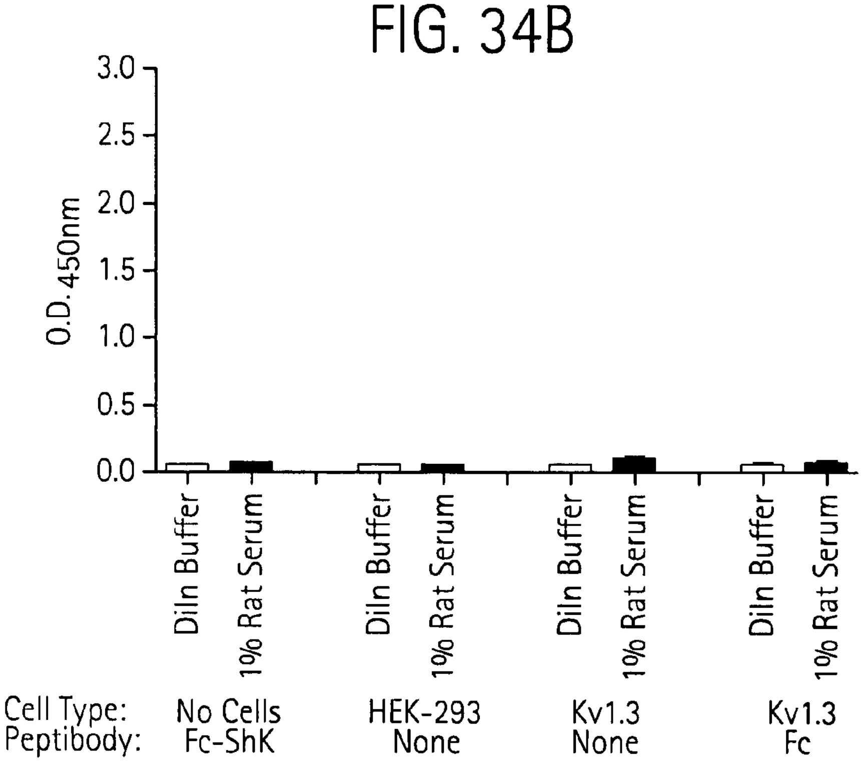

FIG. 34 shows results of an enzyme-immunoassay using fixed HEK 293 cells stably transfected with human Kv1.3. FIG. 34A shows the CHO-derived Fc-L10-ShK[1-35] (referred to here simply as "Fc-L10-ShK") peptibody shows a dose-dependent increase in response, whereas the CHO-Fc control ("Fc control") does not. FIG. 34B shows the Fc-L10-ShK[1-35] peptibody (referred to here as "Fc-ShK") does not elicit a response from untransfected HEK 293 cells using similar conditions and also shows other negative controls.

Figure 35A:
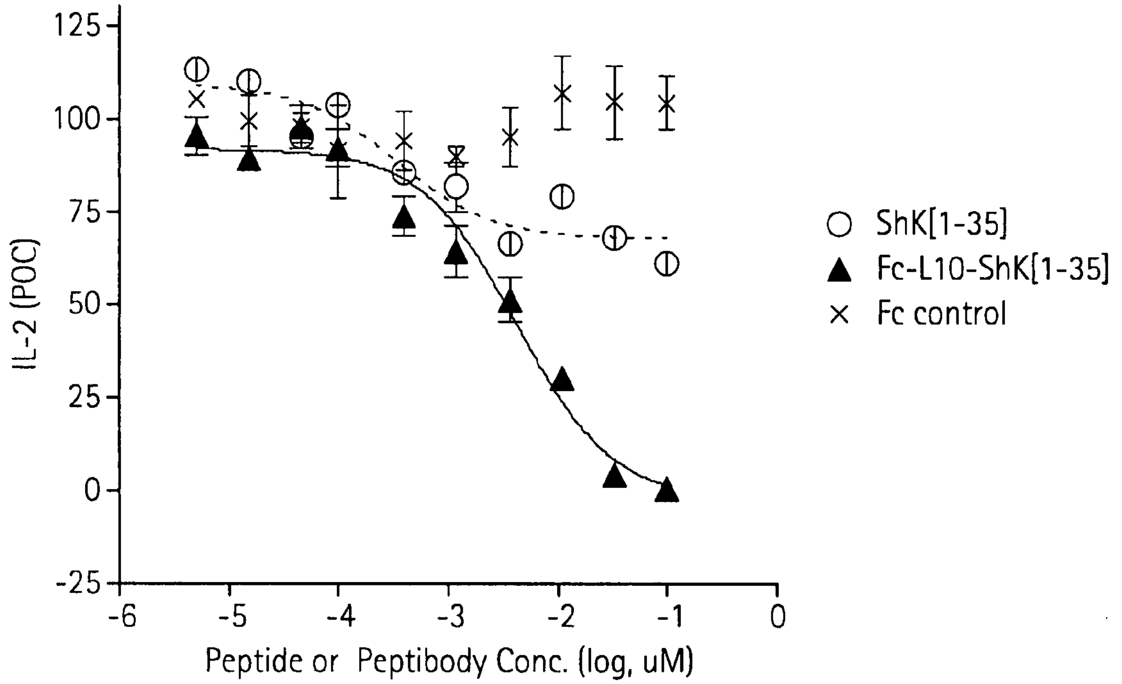
Figure 35B:
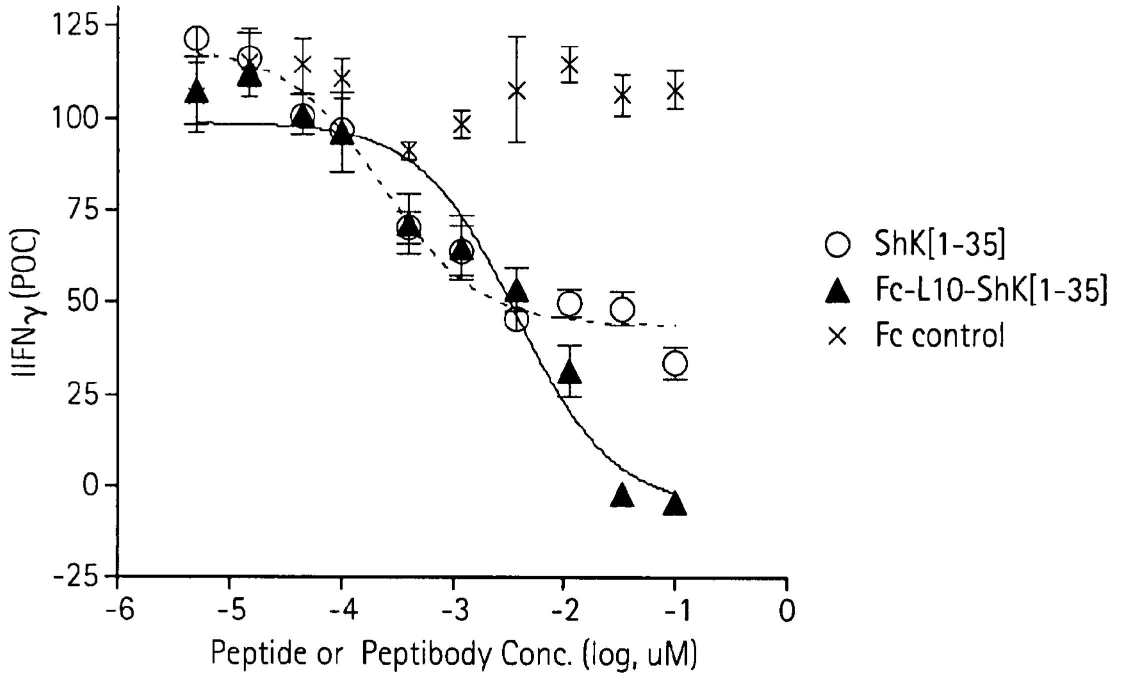

FIG. 35 shows the CHO-derived Fc-L10-ShK[1-35] peptibody shows a dose-dependent inhibition of IL-2 (FIG. 35A) and IFNγ (FIG. 35B) production from PMA and αCD3 antibody stimulated human PBMCs. The peptibody shows a novel pharmacology exhibiting a complete inhibition of the response, whereas the synthetic ShK[1-35] peptide alone shows only a partial inhibition.

Figure 36A:
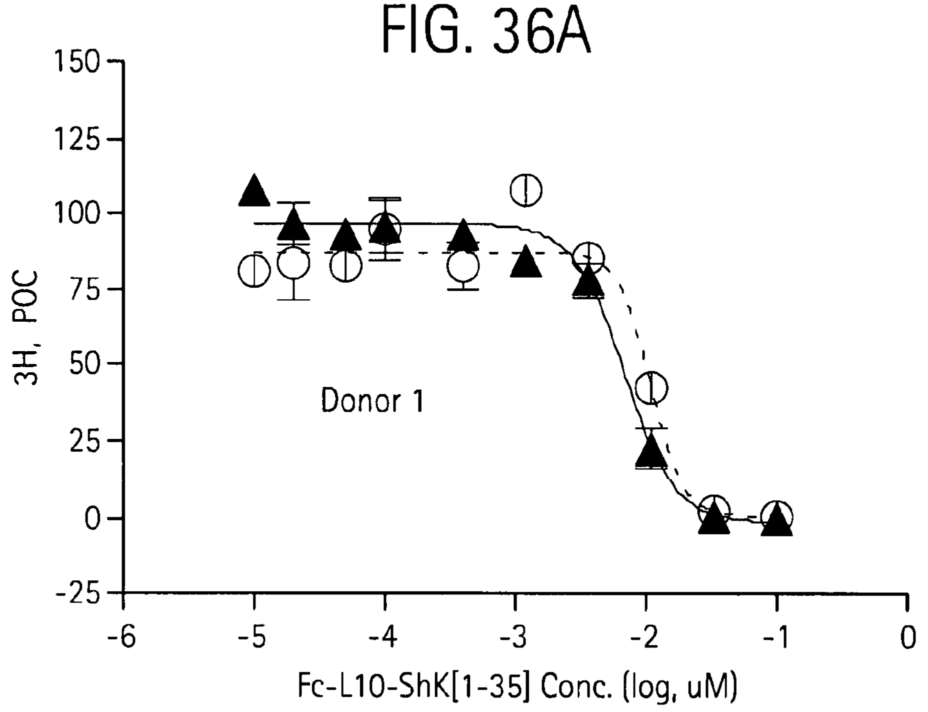
Figure 36B:
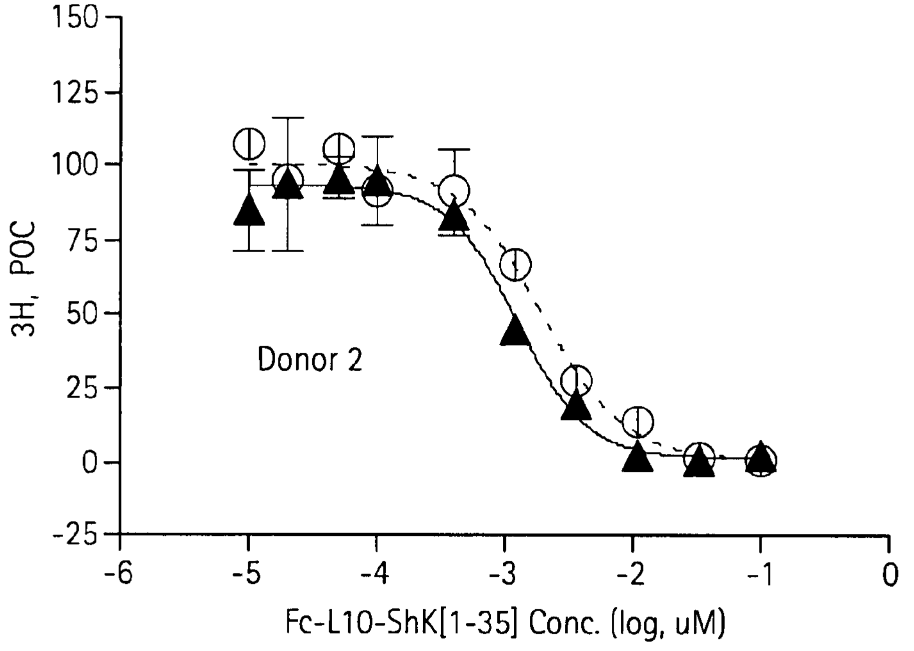

FIG. 36 shows the mammalian-derived Fc-L10-ShK[1-35] peptibody inhibits T cell proliferation (3H-thymidine incorporation) in human PBMCs from two normal donors stimulated with antibodies to CD3 and CD28. FIG. 36A shows the response of donor 1 and FIG. 36B the response of donor 2. Pre-incubation with the anti-CD32 (FcgRII) blocking antibody did not alter the sensitivity toward the peptibody.

Figure 37A:
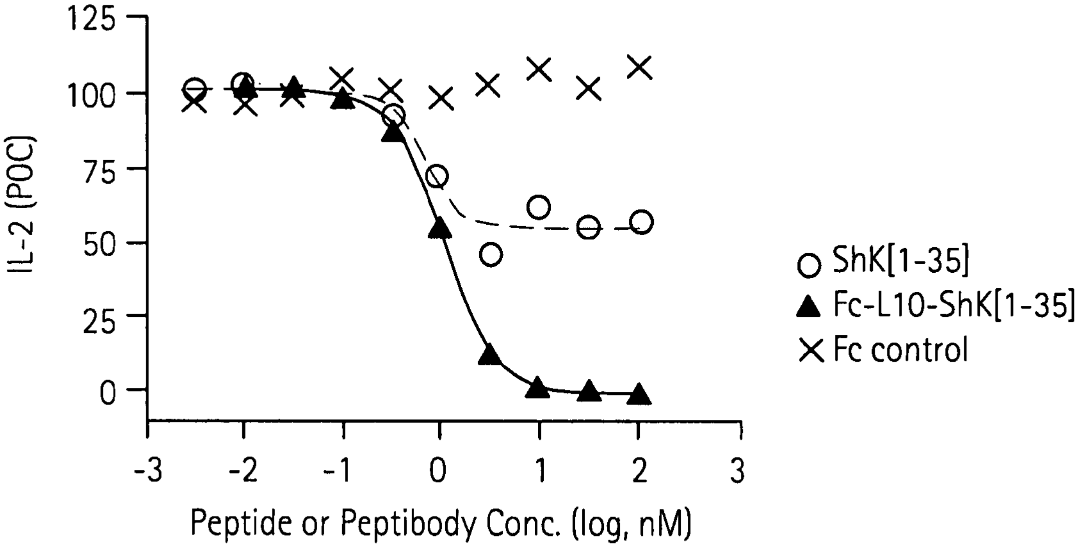
Figure 37B:
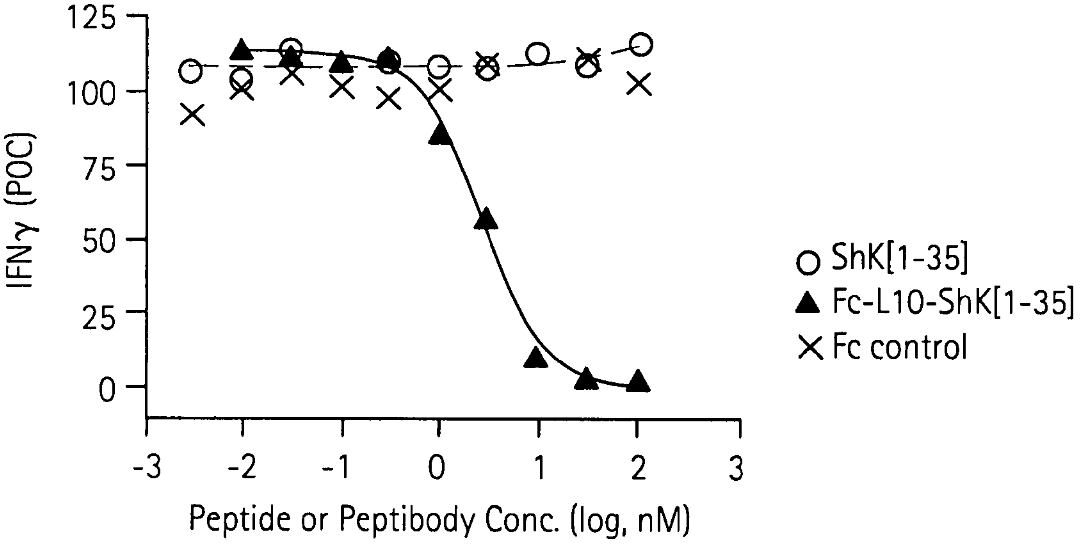

FIG. 37 shows the purified CHO-derived Fc-L10-ShK[1-35] peptibody causes a dose-dependent inhibition of IL-2 (FIG. 37A) and IFNγ (FIG. 37B) production from αCD3 and αCD28 antibody stimulated human PBMCs.

Figure 38A:
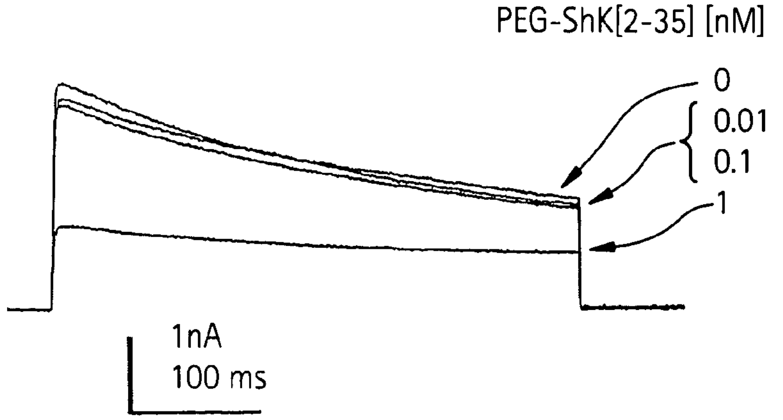
Figure 38B:
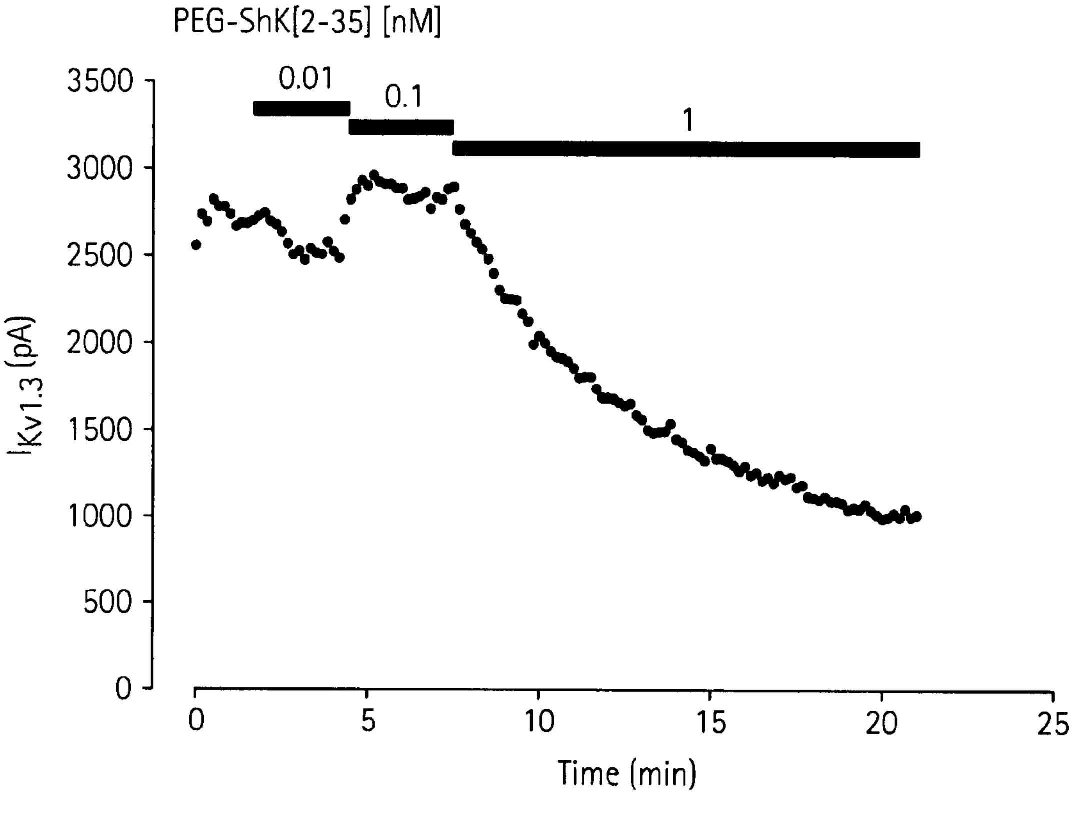

FIG. 38A shows the PEGylated ShK[2-35] synthetic peptide produces a concentration dependent block of the outward potassium current recorded from HEK293 cell stably expressing human Kv1.3 channel and the time course of potassium current block at various concentrations is shown in FIG. 38B.

Figure 39A:
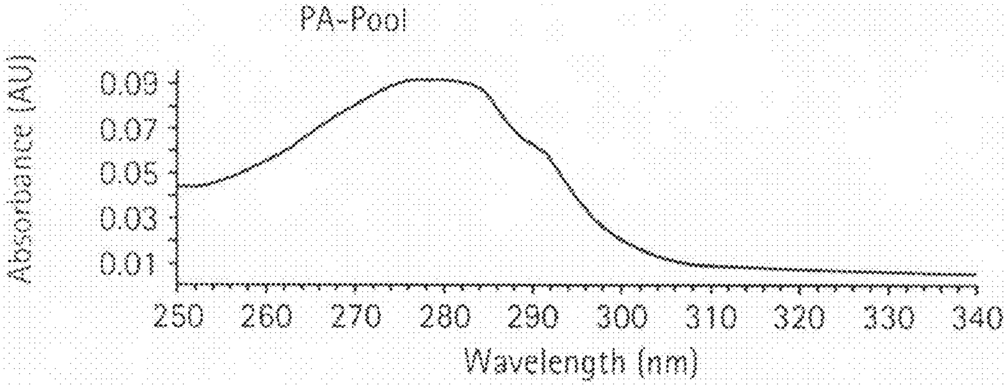

FIG. 39A shows a spectral scan of 50 μl of the Fc-L10-ShK (1-35) product diluted in 700 μl PBS (blanking buffer) using a Hewlett Packard 8453 spectrophotometer and a 1 cm path length quartz cuvette.

Figure 39B:
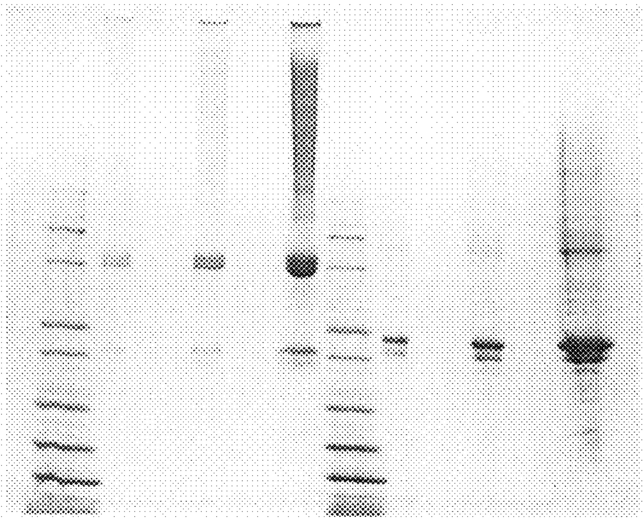

FIG. 39B shows a Coomassie brilliant blue stained tris-glycine 4-20% SDS-PAGE of the final Fc-L10-ShK(1-35) product. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 39C:
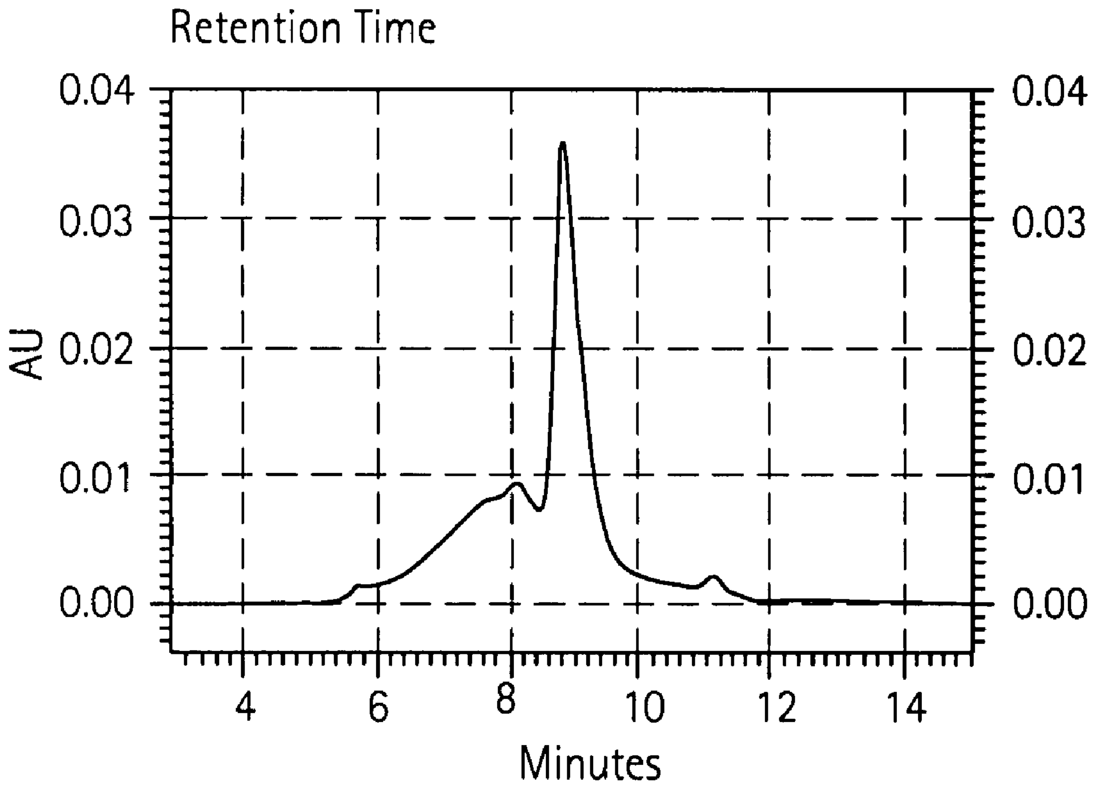

FIG. 39C shows the Size exclusion chromatography on 50 μg of the final Fc-L10-ShK(1-35) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 40A:
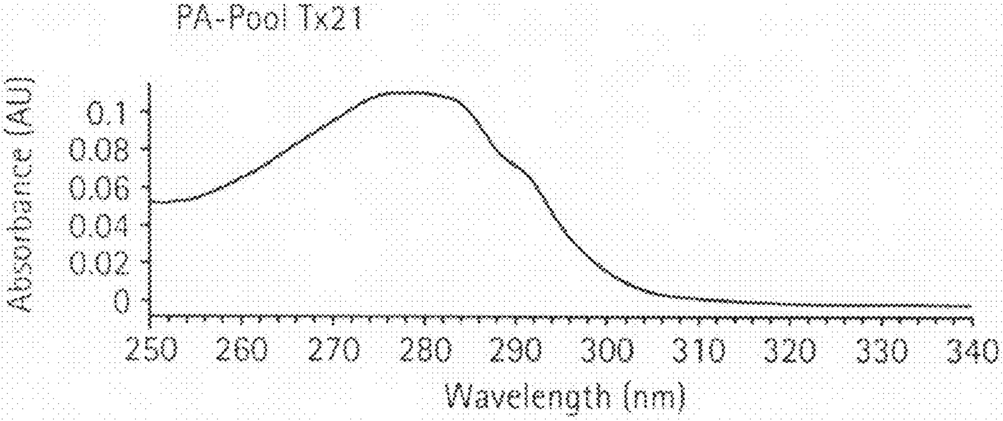

FIG. 40A shows a Spectral scan of 20 μl of the Fc-L10-ShK(2-35) product diluted in 700 μl PBS (blanking buffer) using a Hewlett Packard 8453 spectrophotometer and a 1 cm path length quartz cuvette.

Figure 40B:
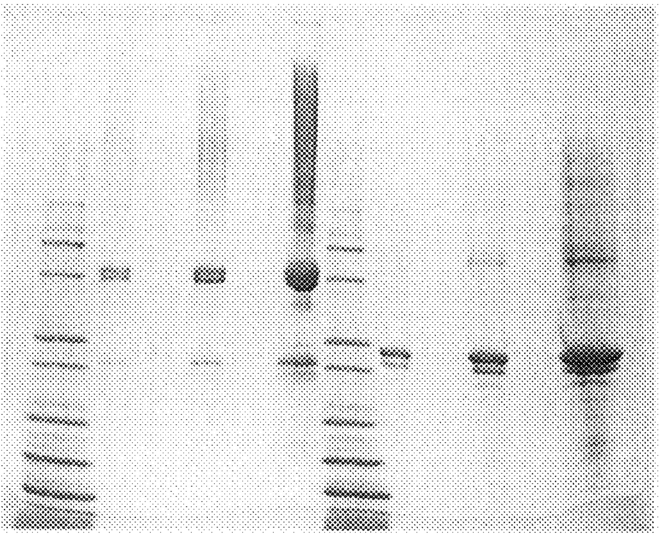

FIG. 40B shows a Coomassie brilliant blue stained tris-glycine 4-20% SDS-PAGE of the final Fc-L10-ShK(2-35) product. Lanes 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 40C:
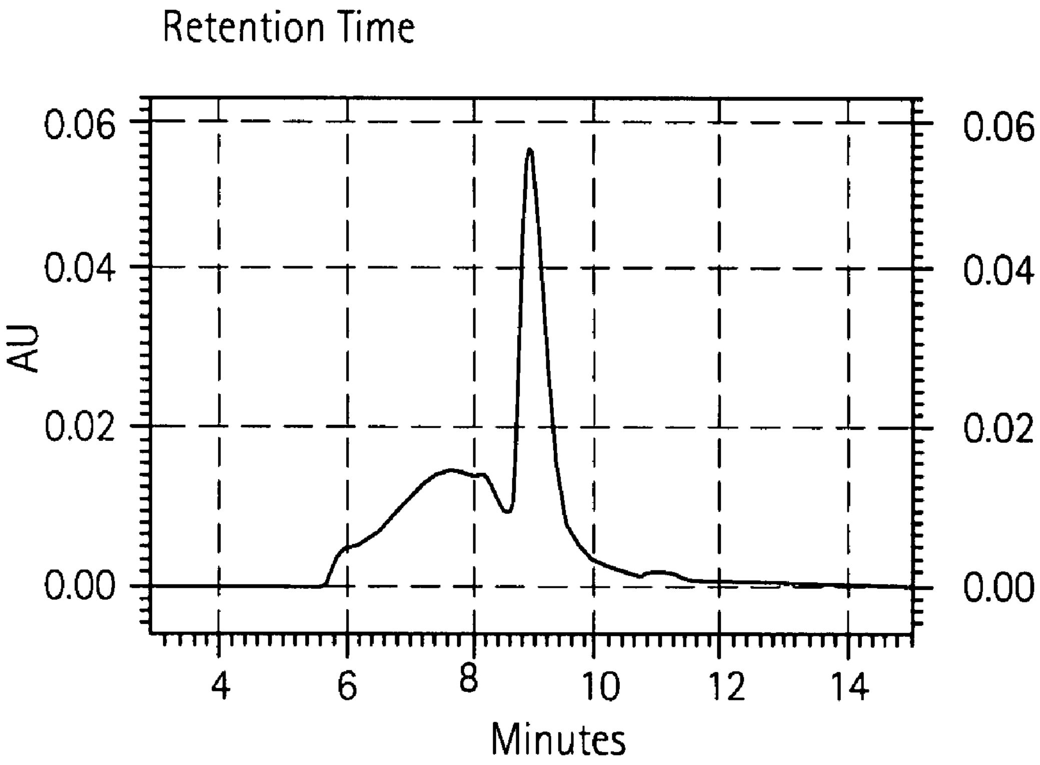

FIG. 40C shows the size exclusion chromatography on 50 μg of the final Fc-L10-ShK(2-35) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 40D:
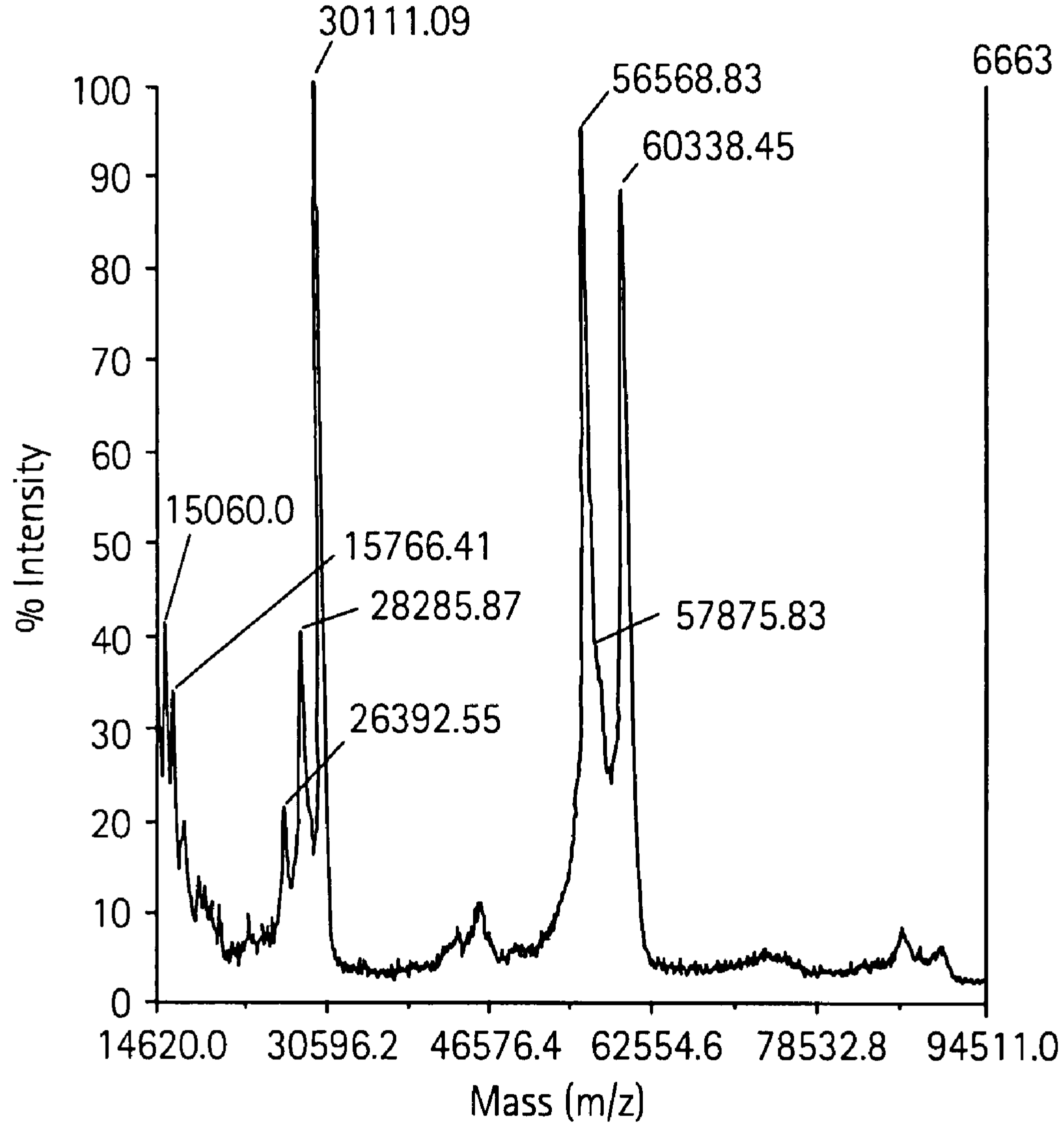

FIG. 40D shows a MALDI mass spectral analysis of the final sample of Fc-L10-ShK(2-35) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 41A:
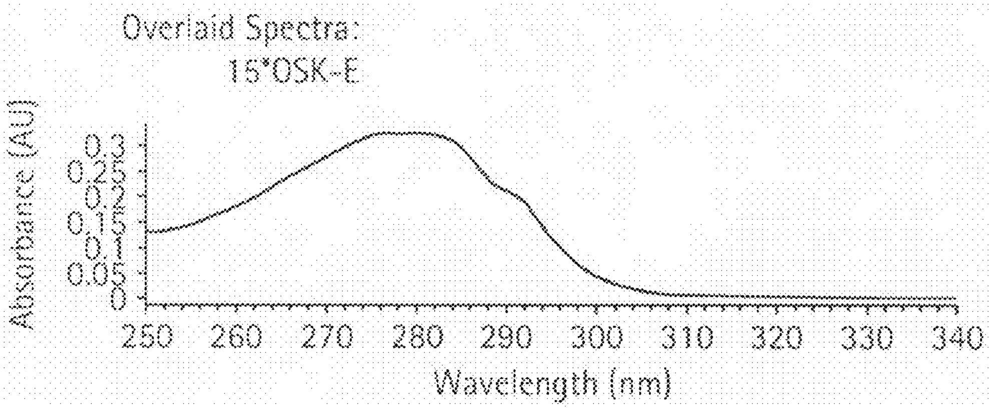

FIG. 41A shows spectral scan of 50 μl of the Fc-L10-OSK1 product diluted in 700 μl Formulation Buffer using a Hewlett Packard 8453 spectrophotometer and a 1 cm path length quartz cuvette.

Figure 41B:
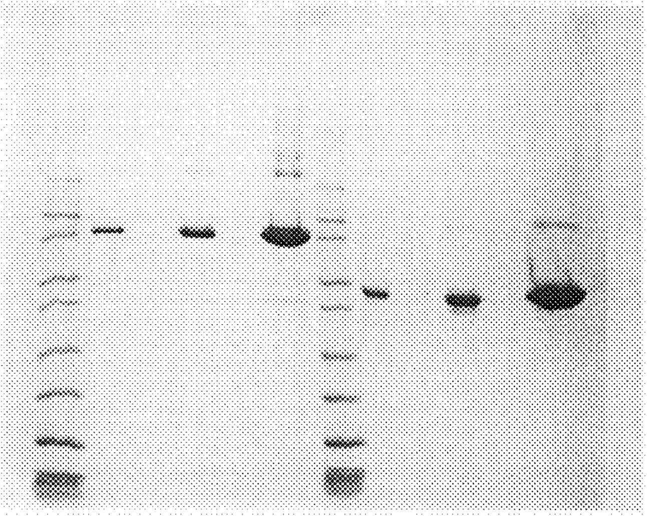

FIG. 41B shows Coomassie brilliant blue stained tris-glycine 4-20% SDS-PAGE of the final Fc-L10-OSK1 product. Lanes 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 41C:
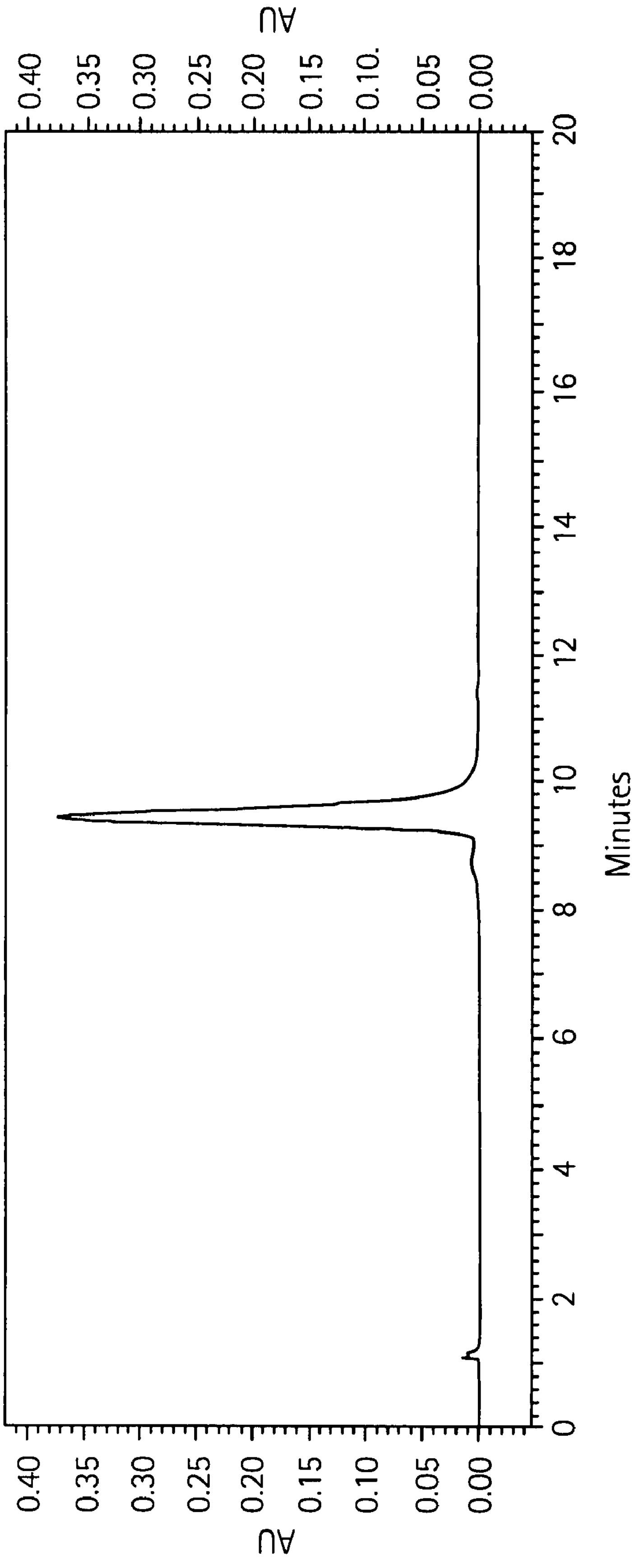

FIG. 41C shows size exclusion chromatography on 123 μg of the final Fc-L10-OSK1 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 41D:
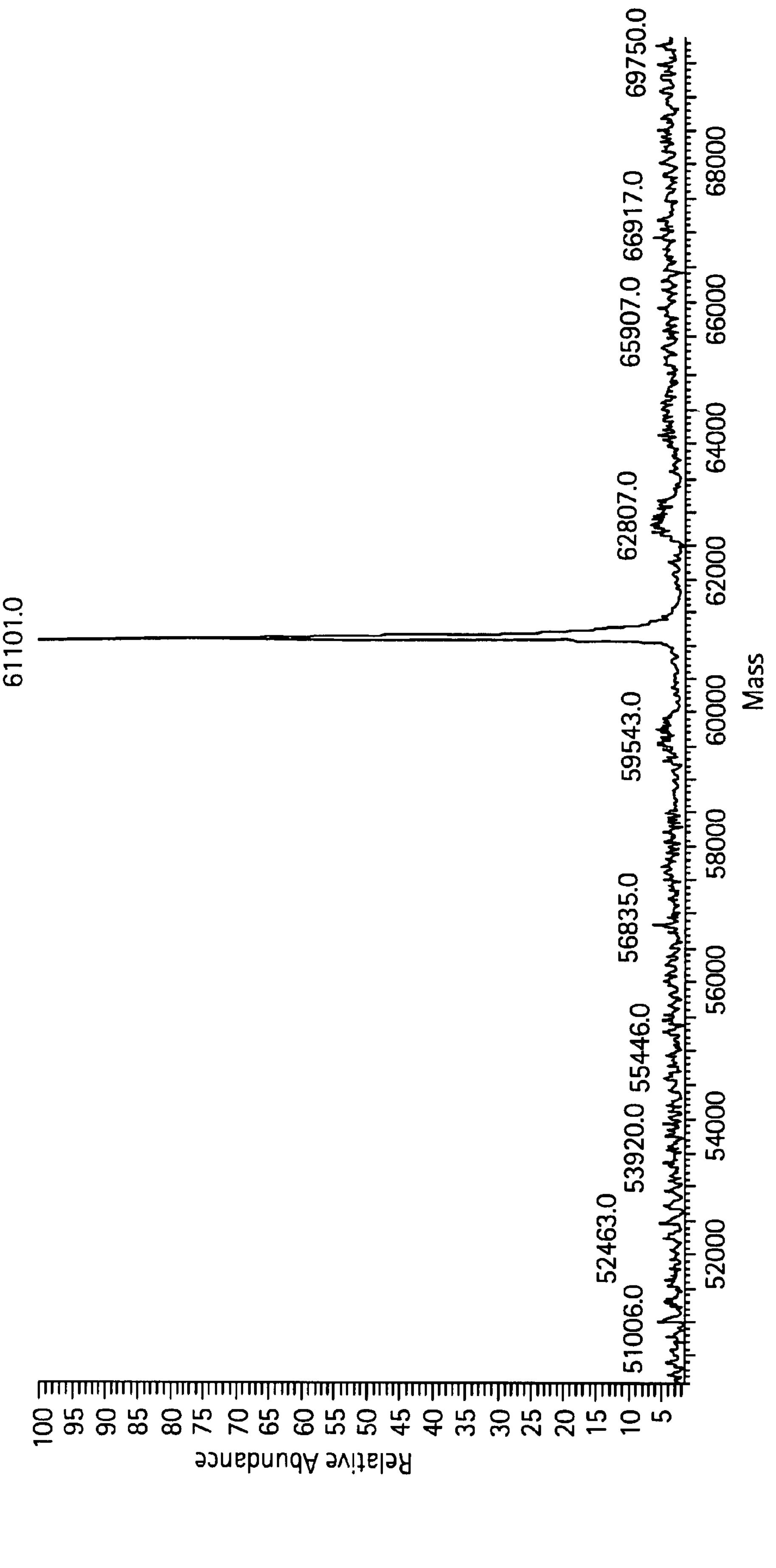

FIG. 41D shows liquid chromatography—mass spectral analysis of approximately 4 μg of the final Fc-L110-OSK1 sample using a Vydac $C_4$ column with part of the effluent directed into a LCQ ion trap mass spectrometer. The mass spectrum was deconvoluted using the Bioworks software provided by the mass spectrometer manufacturer.

FIG. 42A-B shows nucleotide and amino acid sequences (SEQ ID NO: 1040 and SEQ ID NO: 1041, respectively) of Fc-L10-OSK1.

FIG. 43A-B shows nucleotide and amino acid sequences (SEQ ID NO: 1042 and SEQ ID NO: 1043, respectively) of Fc-L10-OSK1[K7S].

FIG. 44A-B shows nucleotide and amino acid sequences (SEQ ID NO: 1044 and SEQ ID NO: 1045, respectively) of Fc-L10-OSK1[E16K,K20D].

FIG. 45A-B shows nucleotide and amino acid sequences (SEQ ID NO: 1046 and SEQ ID NO: 1047, respectively) of Fc-L10-OSK1[K7S,E16K,K20D].

Figure 46:
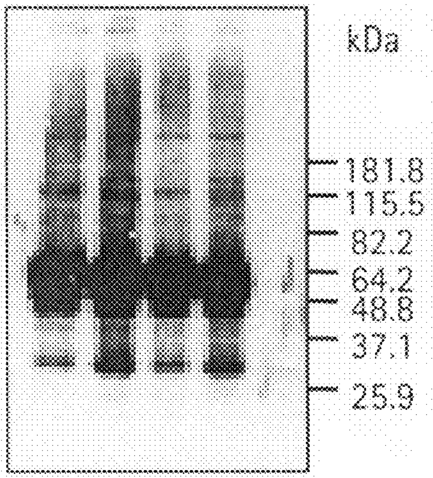

FIG. 46 shows a Western blot (from tris-glycine 4-20% SDS-PAGE) with anti-human Fc antibodies. Lanes 1-6 were loaded as follows: 15 μl of Fc-L10-OSK1[K7S,E16K, K20D]; 15 μl of Fc-L10-OSK1[E16K,K20D]; 15 μl of Fc-L10-OSK1[K7S]; 15 μl of Fc-L10-OSK1; 15 μl of "No DNA" control; molecular weight markers.

Figure 47:
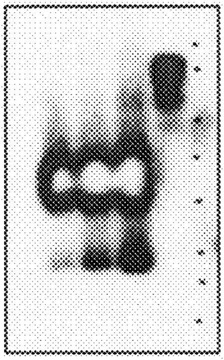

FIG. 47 shows a Western blot (from tris-glycine 4-20% SDS-PAGE) with anti-human Fc antibodies. Lanes 1-5 were loaded as follows: 21 of Fc-L10-OSK1; 5 μl of Fc-L10-OSK1; 10 μl of Fc-L10-OSK1; 20 ng Human IgG standard; molecular weight markers.

Figure 48:
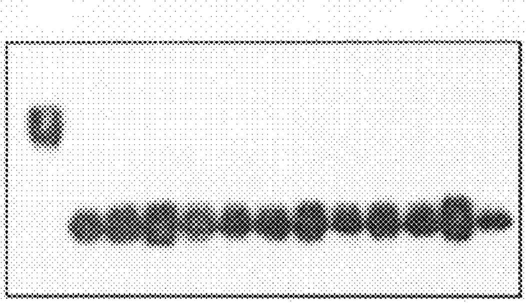

FIG. 48 shows a Western blot (from tris-glycine 4-20% SDS-PAGE) with anti-human Fc antibodies. Lanes 1-13 were loaded as follows: 20 ng Human IgG standard; D1; C3; C2; B6; B5; B2; B1; A6; A5; A4; A3; A2 (5 μl of clone-conditioned medium loaded in lanes 2-13).

Figure 49A:
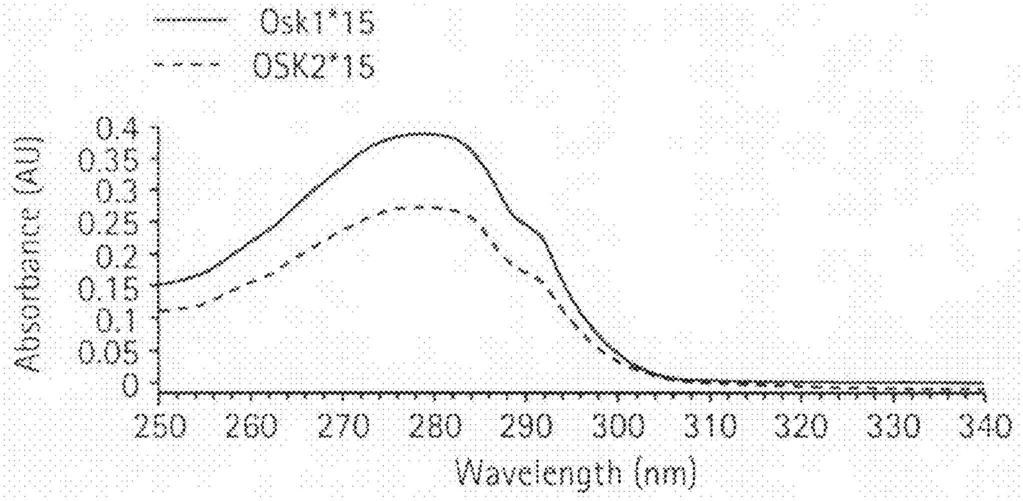

FIG. 49A shows a spectral scan of 50 μl of the Fc-L10-OSK1 product diluted in 700 μl PBS (blanking buffer) using a Hewlett Packard 8453 spectrophotometer and a 1 cm path length quartz cuvette.

Figure 49B:
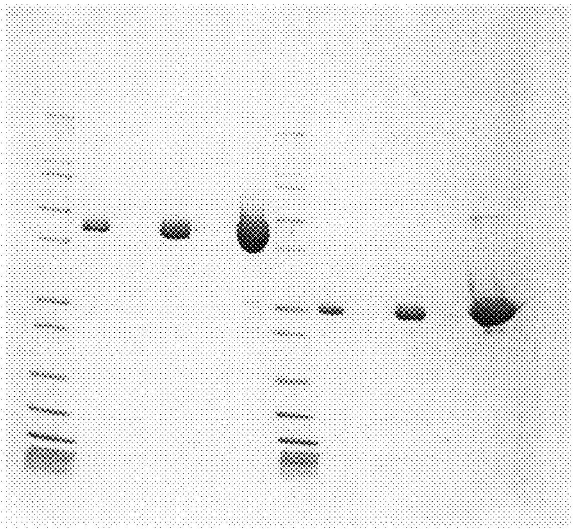

FIG. 49B shows Coomassie brilliant blue stained tris-glycine 4-20% SDS-PAGE of the final Fc-L10-OSK1 product. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 49C:
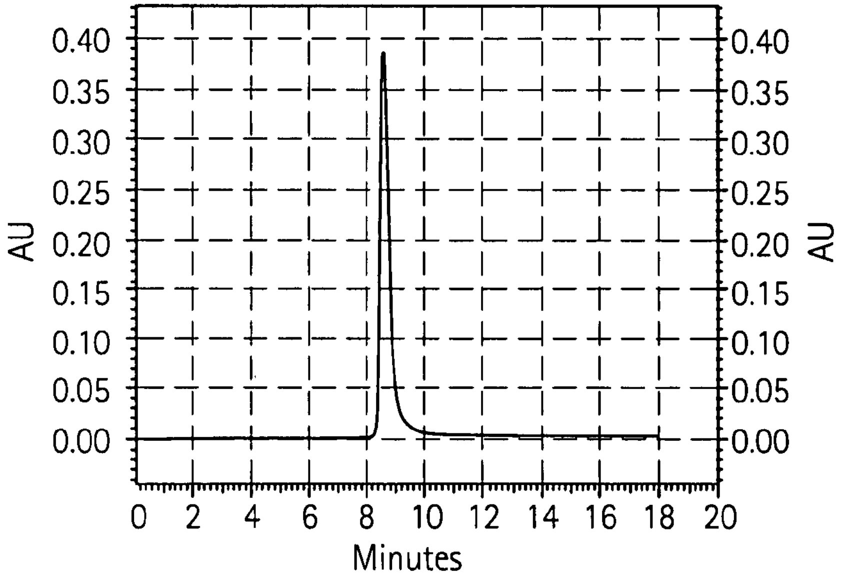

FIG. 49C shows Size exclusion chromatography on 149 μg of the final Fc-L10-OSK1 product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 49D:
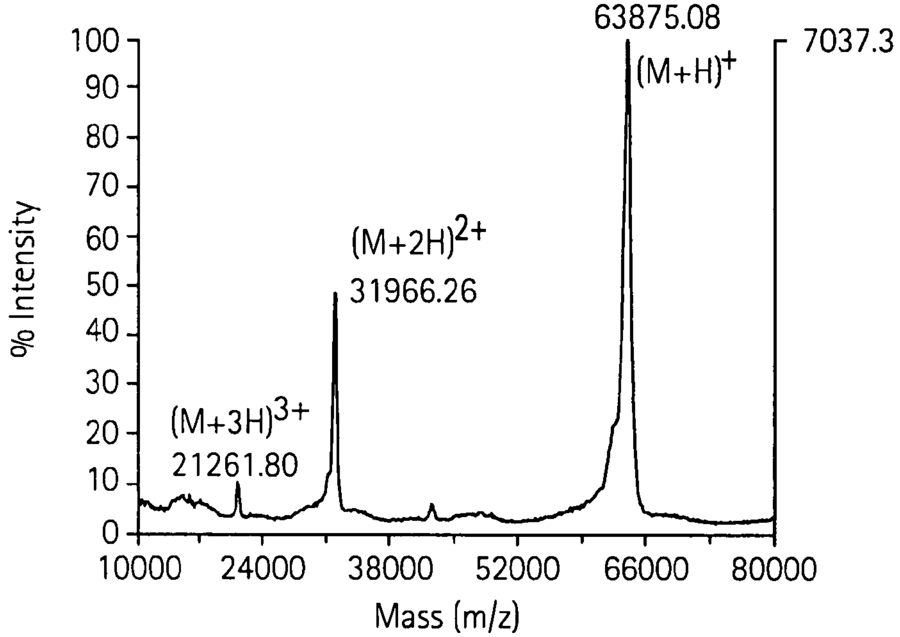

FIG. 49D shows MALDI mass spectral analysis of the final sample of Fc-L10-OsK1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 50A:
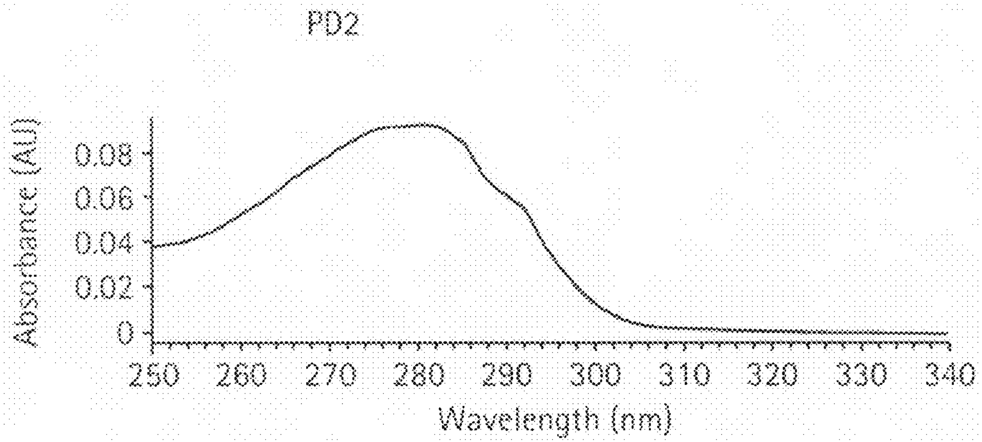

FIG. 50A shows a spectral scan of 50 μl of the Fc-L10-OsK1(K7S) product diluted in 700 μl PBS (blanking buffer) using a Hewlett Packard 8453 spectrophotometer and a 1 cm path length quartz cuvette.

Figure 50B:
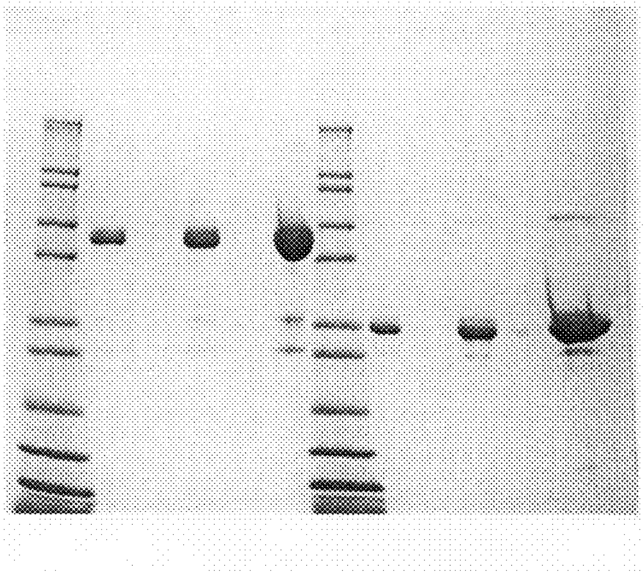

FIG. 50B shows Coomassie brilliant blue stained tris-glycine 4-20% SDS-PAGE of the final Fc-L10-OsK1(K7S) product. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 50C:
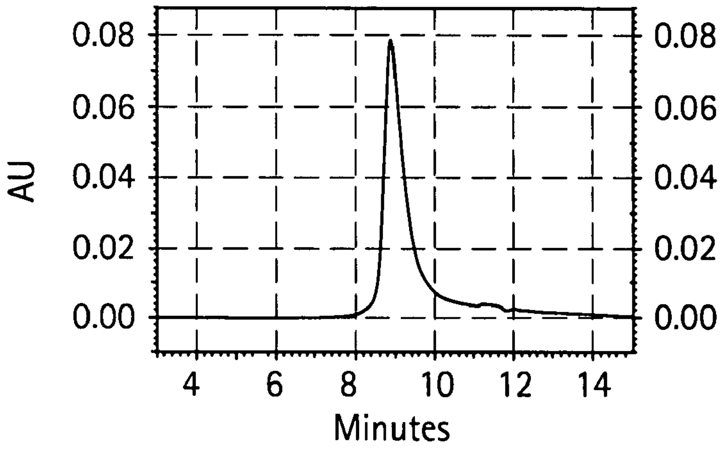

FIG. 50C shows size exclusion chromatography on 50 μg of the final Fc-L10-OsK1(K7S) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 50D:
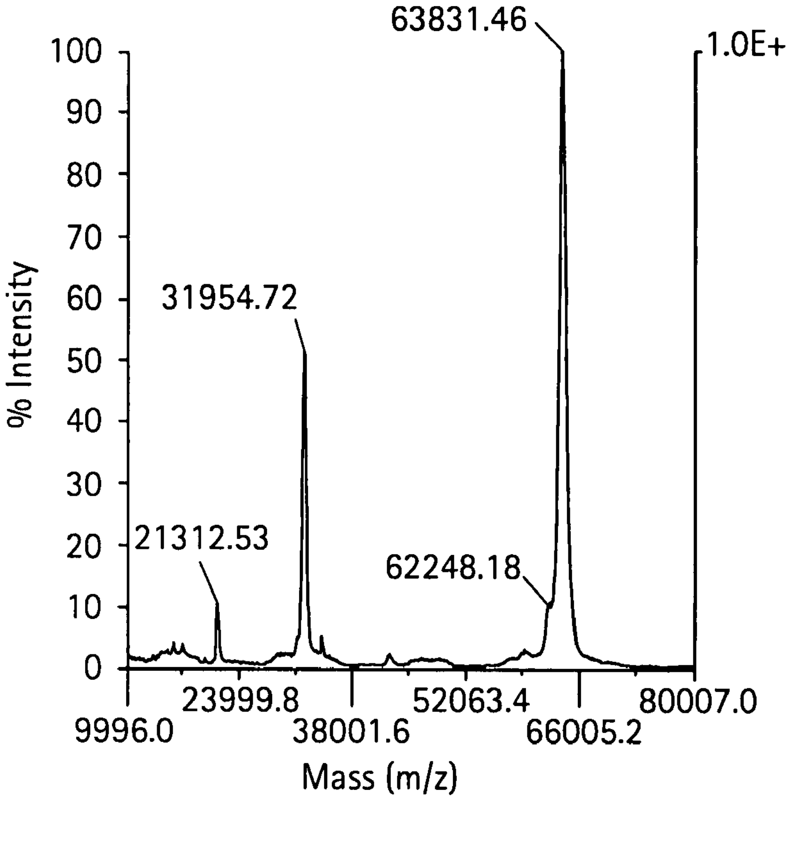

FIG. 50D shows MALDI mass spectral analysis of a sample of the final product Fc-L10-OsK1 (K7S) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 51A:
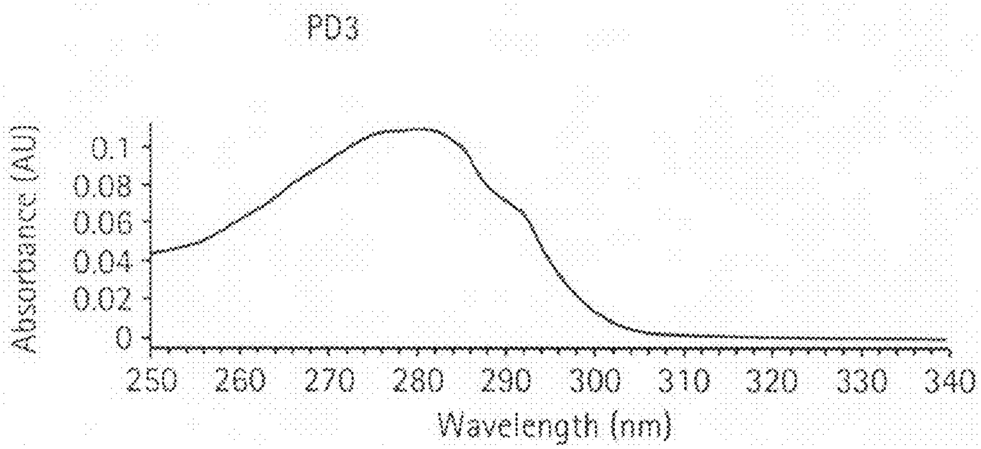

FIG. 51A shows a spectral scan of 50 μl of the Fc-L10-OsK1(E16K, K20D) product diluted in 700 μl PBS (blanking buffer) using a Hewlett Packard 8453 spectrophotometer and a 1 cm path length quartz cuvette.

Figure 51B:
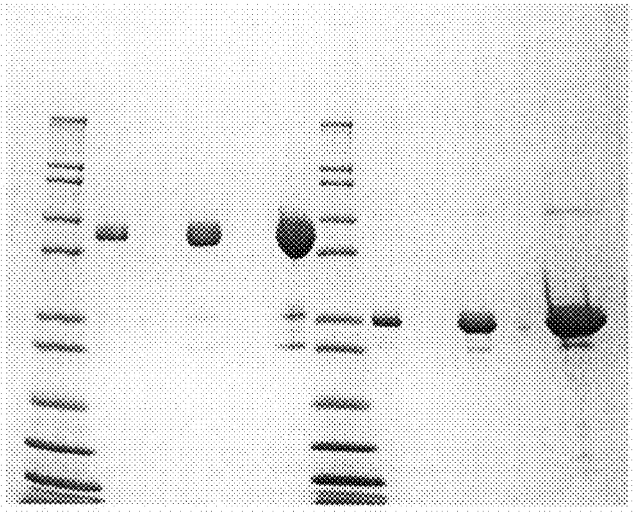

FIG. 51B shows Coomassie brilliant blue stained tris-glycine 4-20% SDS-PAGE of the final Fc-L10-OsK1(E16K, K20D) product. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 51C:
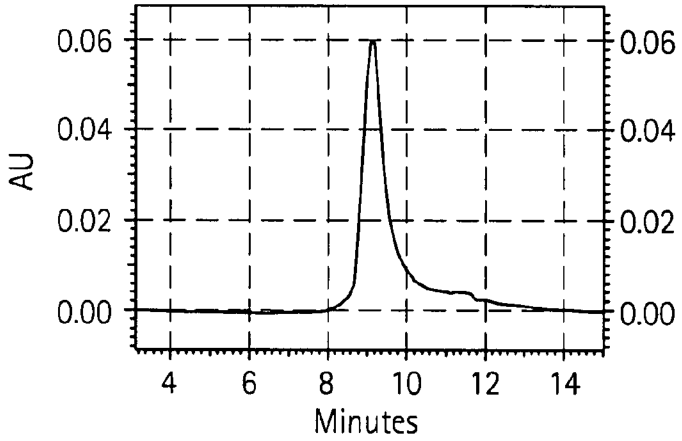

FIG. 51C shows size exclusion chromatography on 50 μg of the final Fc-L10-OsK1(E16K, K20D) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 51D:
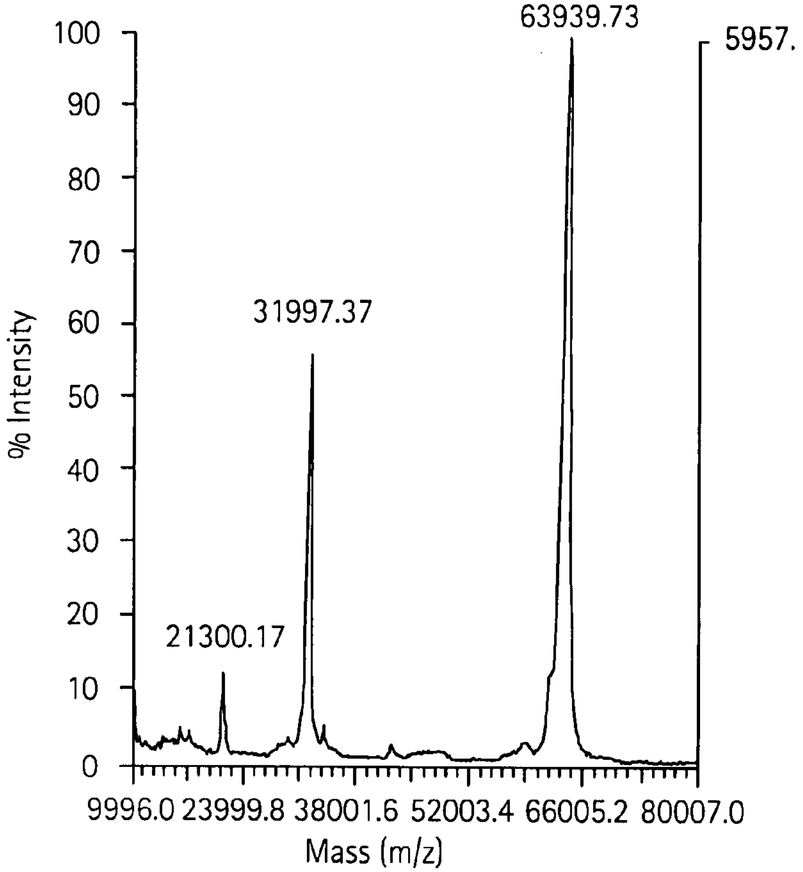

FIG. 51D shows MALDI mass spectral analysis of a sample of the final product Fc-L10-OsK1 (E16K, K20D) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 52A:
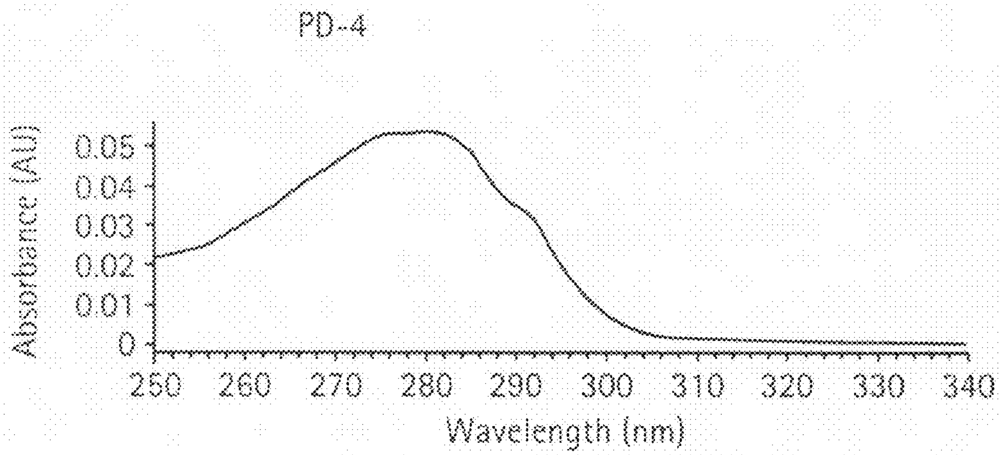

FIG. 52A shows a spectral scan of 50 μl of the Fc-L110-OsK1 (K7S, E16K, K20D) product diluted in 700 μl PBS (blanking buffer) using a Hewlett Packard 8453 spectrophotometer and a 1 cm path length quartz cuvette.

Figure 52B:
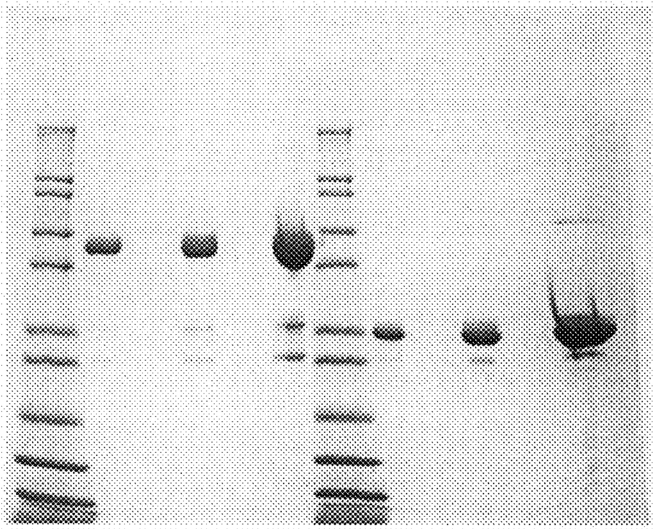

FIG. 52B shows Coomassie brilliant blue stained tris-glycine 4-20% SDS-PAGE of the final Fc-L10-OsK1(K7S, E16K, K20D) product. Lanes 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 52C:
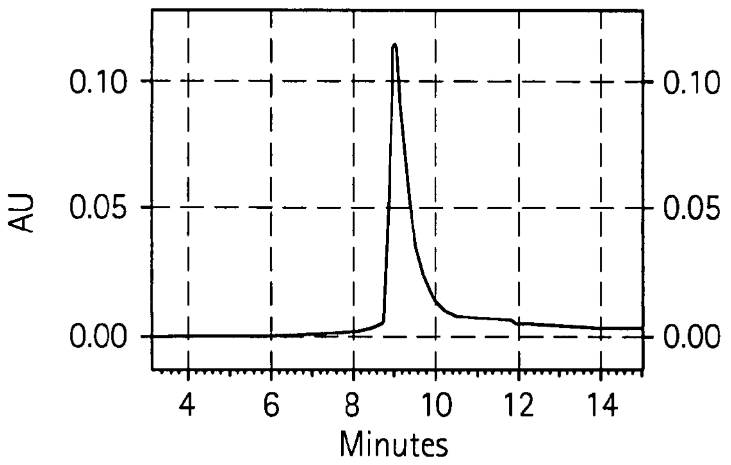

FIG. 52C shows size exclusion chromatography on 50 μg of the final Fc-L10-OsK1(K7S, E16K, K20D) product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 52D:
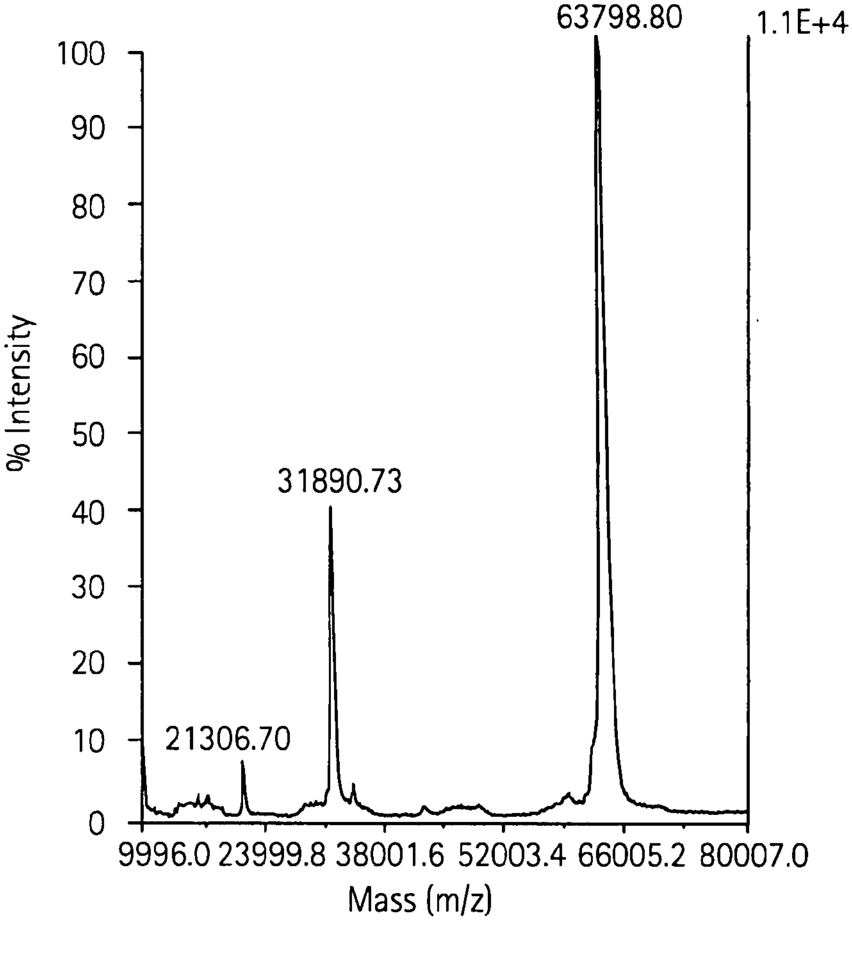

FIG. 52D shows MALDI mass spectral analysis of a sample of the final product Fc-L10-OsK1(K7S, E16K, K20D) analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 53A:
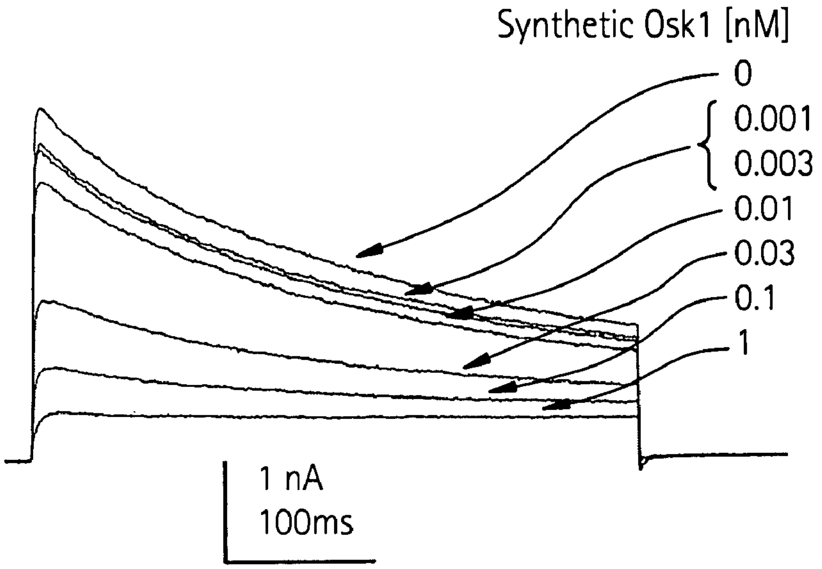
Figure 53B:
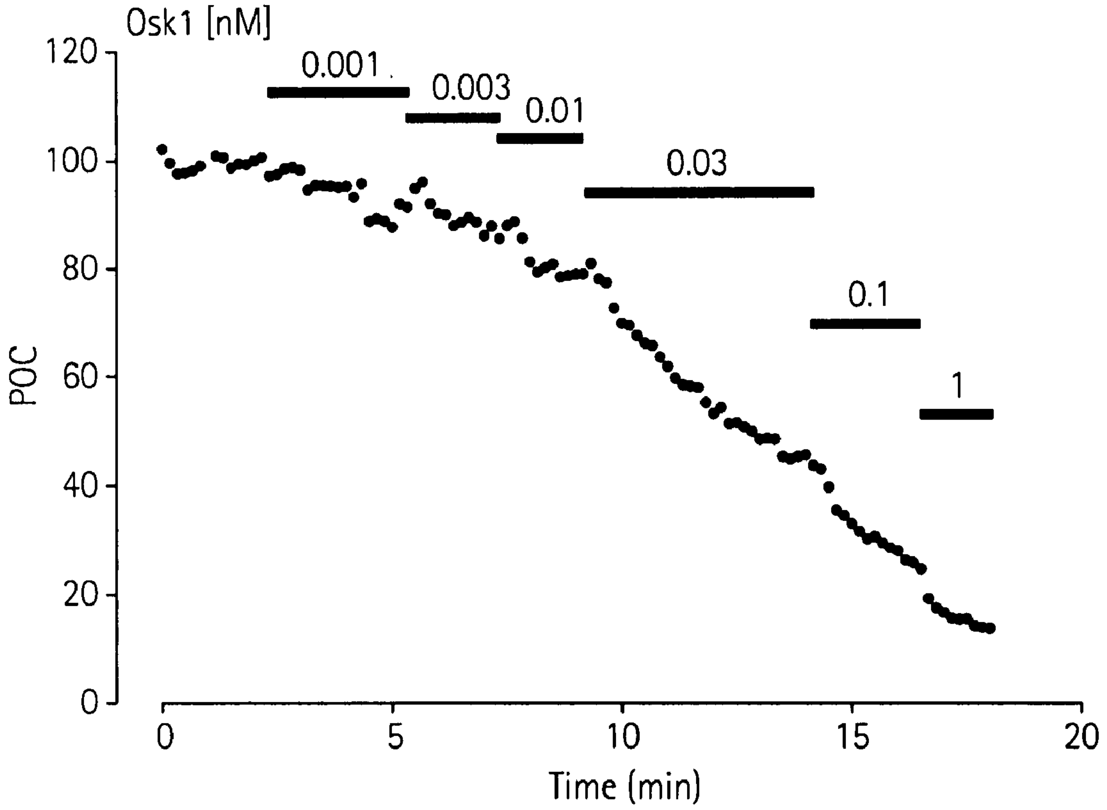

FIG. 53 shows inhibition of the outward potassium current recorded from HEK293 cell stably expressing human Kv1.3 channel by synthetic Osk1, a 38-residue toxin peptide of the Asian scorpion *Orthochirus scrobiculosus* venom. FIG. 53A shows a concentration dependent block of the outward potassium current recorded from HEK293 cell stably expressing human Kv1.3 channel by the synthetic Osk1 toxin peptide. FIG. 53B shows the time course of the synthetic Osk1 toxin peptide block at various concentrations. The IC50 for the synthetic Osk1 toxin peptide was estimated to be 39±12 pM (n=4 cells).

Figure 54A:
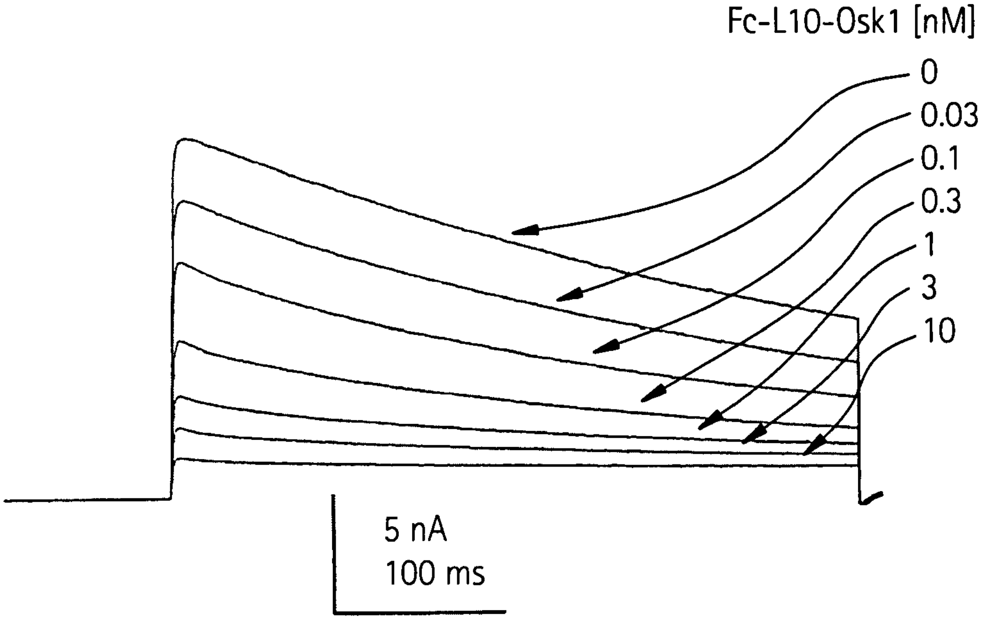
Figure 54B:
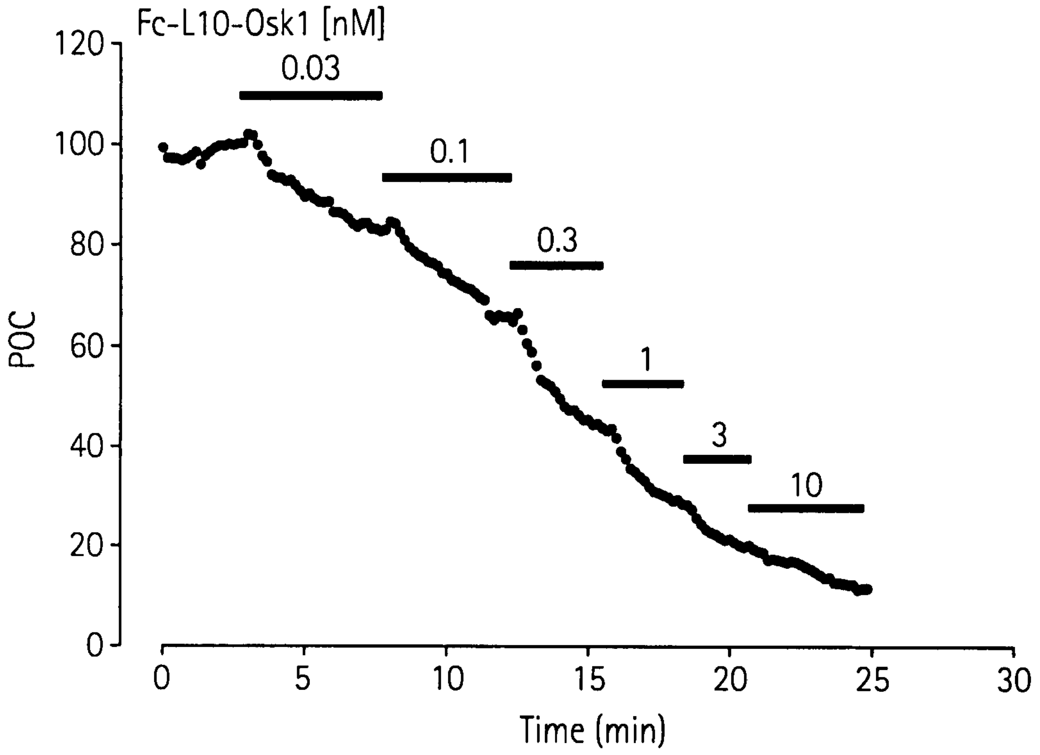

FIG. 54 shows that modification of the synthetic OSK1 toxin peptide by fusion to the Fc-fragment of an antibody (OSK1-peptibody) retained the inhibitory activity against the human Kv1.3 channel. FIG. 54A shows a concentration dependent block of the outward potassium current recorded from HEK293 cells stably expressing human Kv1.3 channel by OSK1 linked to a human IgG1 Fc-fragment with a linker chain length of 10 amino acid residues (Fc-L10-OSK1). The fusion construct was stably expressed in Chinese Hamster Ovarian (CHO) cells. FIG. 54B shows the time course of the Fc-L10-OSK1 block at various concentrations. The IC50 for Fc-L10-OSK1 was estimated to be 198±35 pM (n=6 cells), approximately 5-fold less potent than the synthetic OSK1 toxin peptide.

Figure 55A:
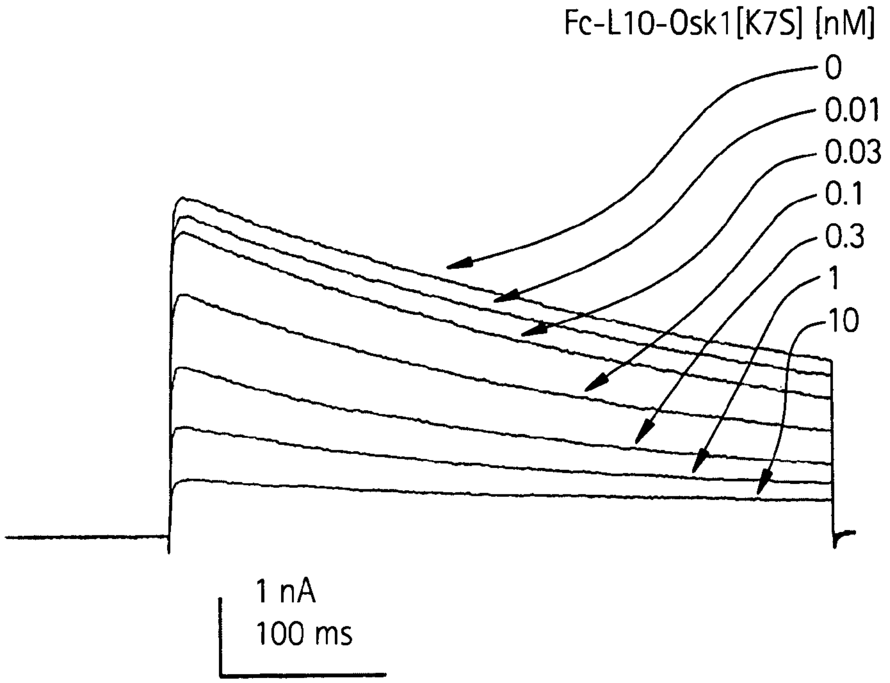
Figure 55B:
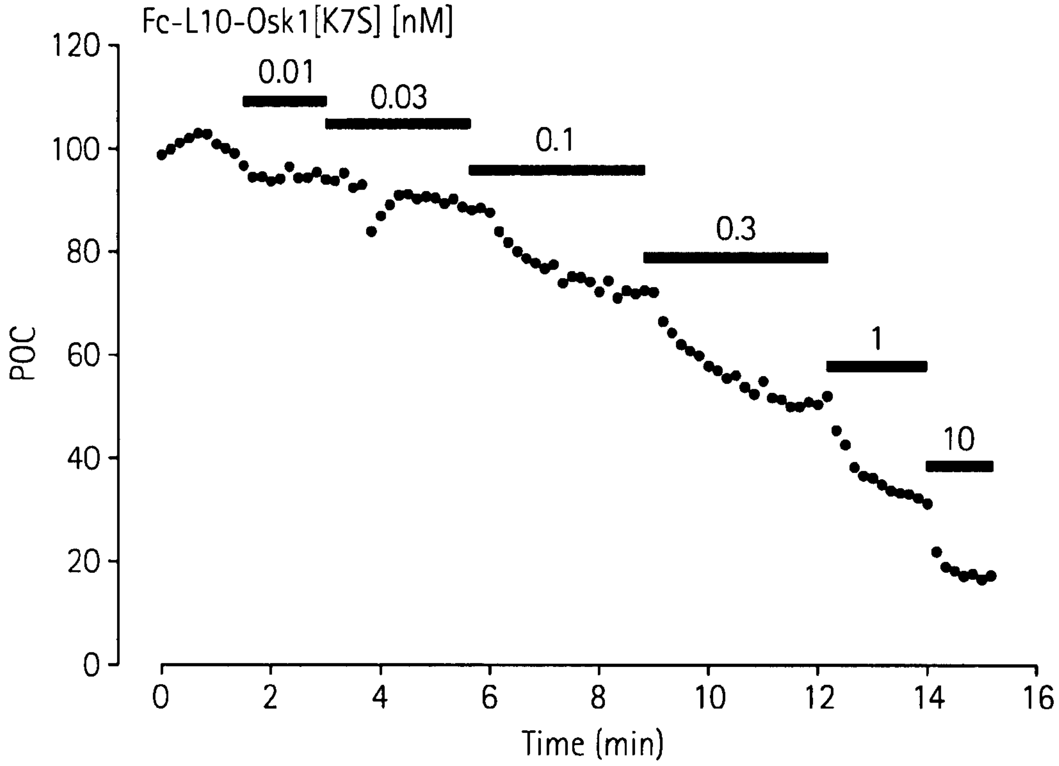

FIG. 55 shows that a single amino-acid residue substitution of the OSK1-peptibody retained the inhibitory activity against the human Kv1.3 channel. FIG. 55A shows a concentration dependent block of the outward potassium current recorded from HEK293 cell stably expressing human Kv1.3 channel by OSK1-peptibody with a single amino acid substitution (lysine to serine at the $7^{th}$ position from N-terminal, [K7S]) and linked to a human IgG1 Fc-fragment with a linker chain length of 10 amino acid residues (Fc-L10-OSK1 [K7S]). The fusion construct was stably expressed in Chinese Hamster Ovarian (CHO) cells. FIG. 55B shows the time course of potassium current block by Fc-L10-OSK1[K7S] at various concentrations. The IC50 was estimated to be 372±71 pM (n=4 cells), approximately 10-fold less potent than the synthetic OSK1 toxin peptide.

Figure 56A:
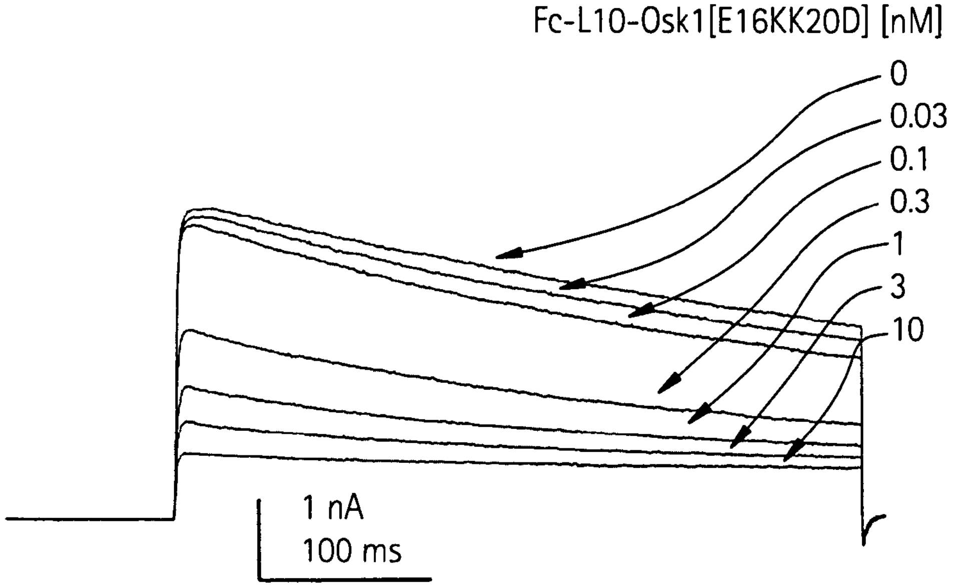
Figure 56B:
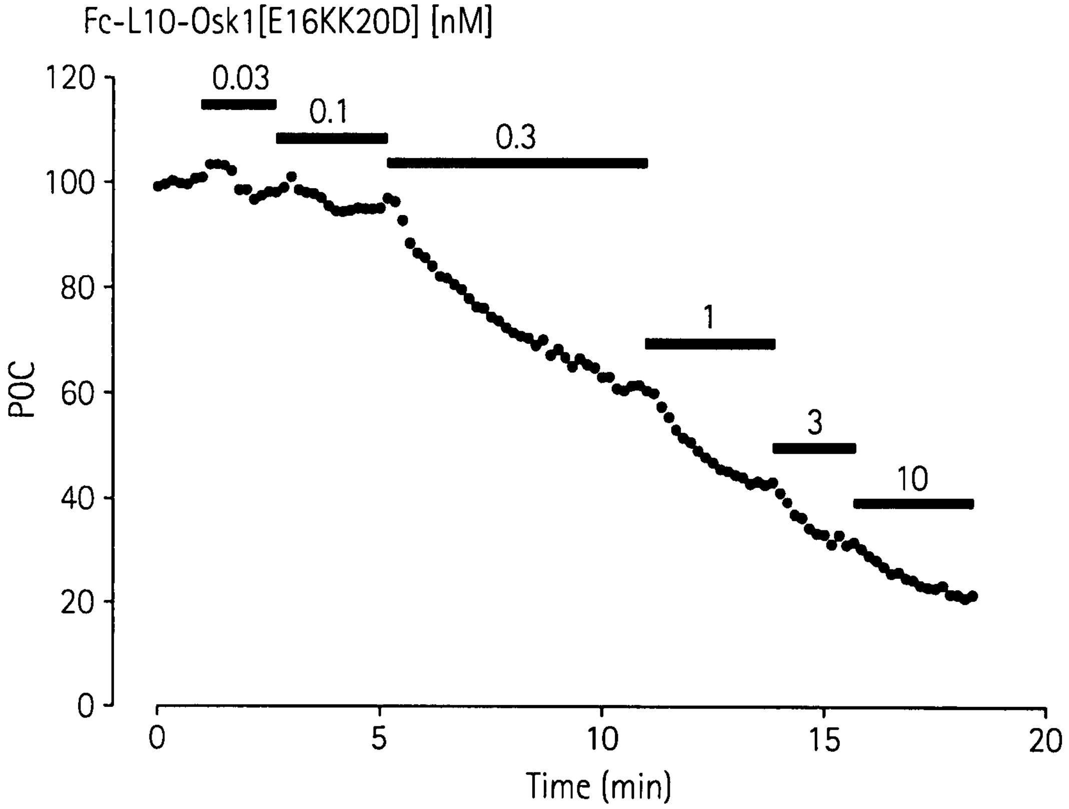

FIG. 56 shows that a two amino-acid residue substitution of the OSK1-peptibody retained the inhibitory activity against the human Kv1.3 channel. FIG. 56A shows a concentration dependent block of the outward potassium current recorded from HEK293 cell stably expressing human Kv1.3 channel by OSK1-peptibody with two amino acid substitutions (glutamic acid to lysine and lysine to aspartic acid at the $16^{th}$ and $20^{th}$ position from N-terminal respectively, [E16KK20D]) and linked to a human IgG1 Fc-fragment with a linker chain length of 10 amino acid residues (Fc-L10-OSK1[E16KK20D]). The fusion construct was stably expressed in Chinese Hamster Ovarian (CHO) cells. FIG. 56B shows the time course of potassium current block by Fc-L10-OSK1[E16KK20D] at various concentrations. The IC50 was estimated to be 248±63 pM (n=3 cells), approximately 6-fold less potent than the synthetic OSK1 toxin peptide.

Figure 57A:
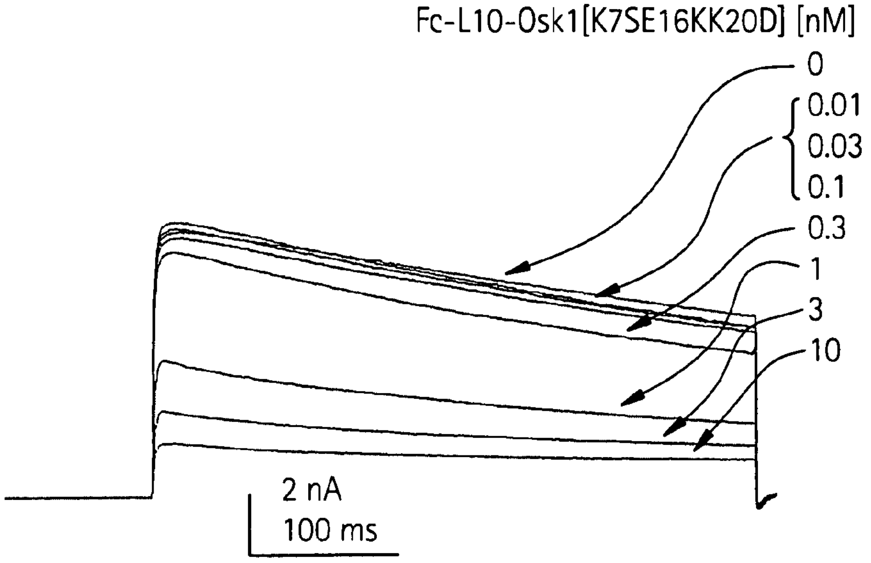
Figure 57B:
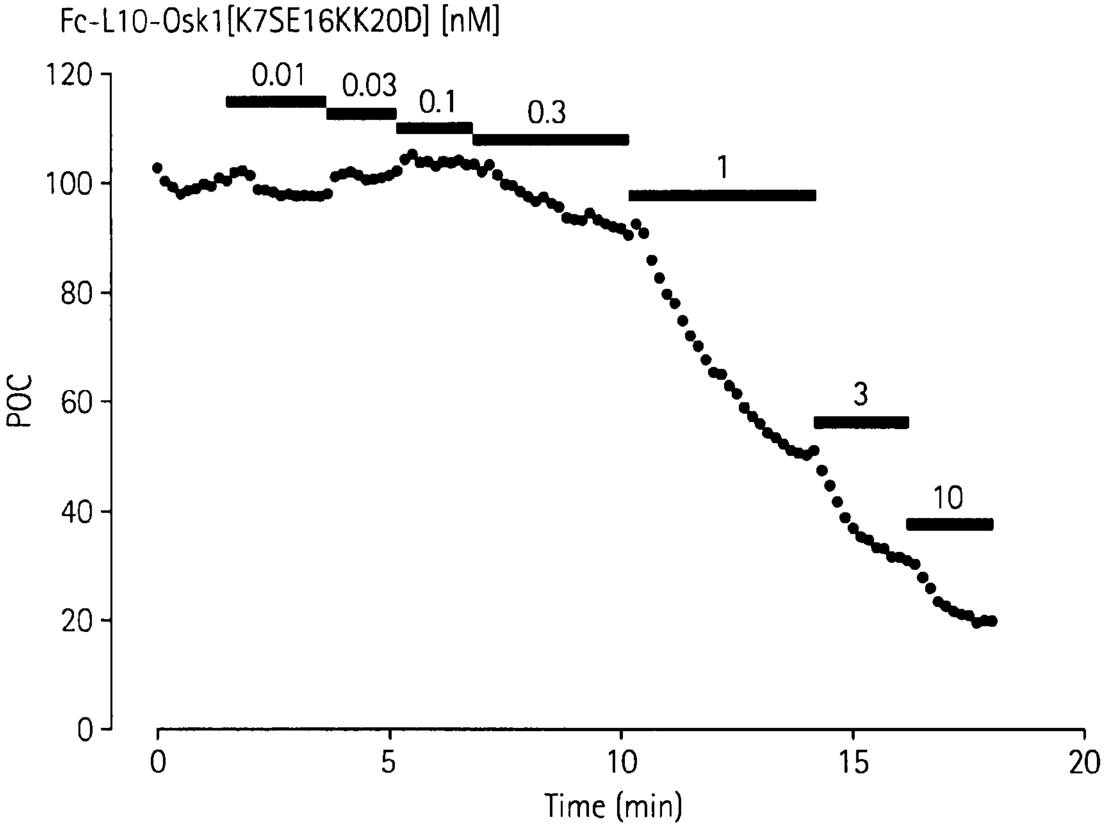

FIG. 57 shows that a triple amino-acid residue substitution of the OSK1-peptibody retained the inhibitory activity against the human Kv1.3 channel, but the potency of inhibition was significantly reduced when compared to the synthetic OSK1 toxin peptide. FIG. 57A shows a concentration dependent block of the outward potassium current recorded from HEK293 cell stably expressing human Kv1.3 channel by OSK1-peptibody with triple amino acid substitutions (lysine to serine, glutamic acid to lysine and lysine to aspartic acid at the $7^{th}$, $16^{th}$ and $20^{th}$ position from N-terminal respectively, [K7SE16KK20D]) and linked to a human IgG1 Fc-fragment with a linker chain length of 10 amino acid residues (Fc-L10-OSK1[K7SE16KK20D]). The fusion construct was stably expressed in Chinese Hamster Ovarian (CHO) cells. FIG. 57B shows the time course of potassium current block by Fc-L10-OSK1[K7SE16KK20D] at various concentrations. The IC50 was estimated to be 812±84 pM (n=3 cells), approximately 21-fold less potent than the synthetic OSK1 toxin peptide.

Figure 58A:
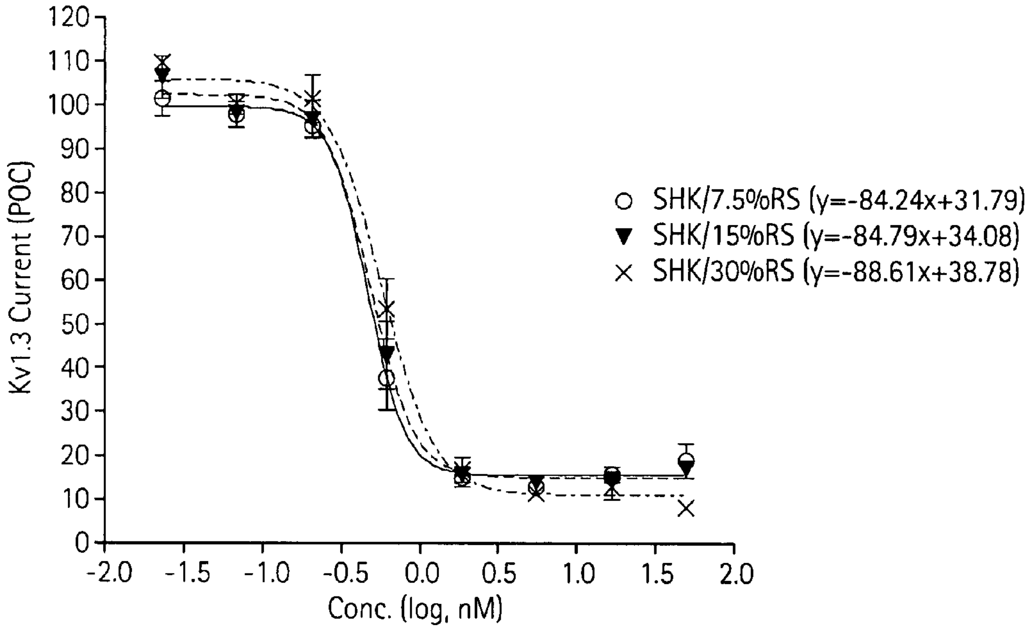
Figure 58B:
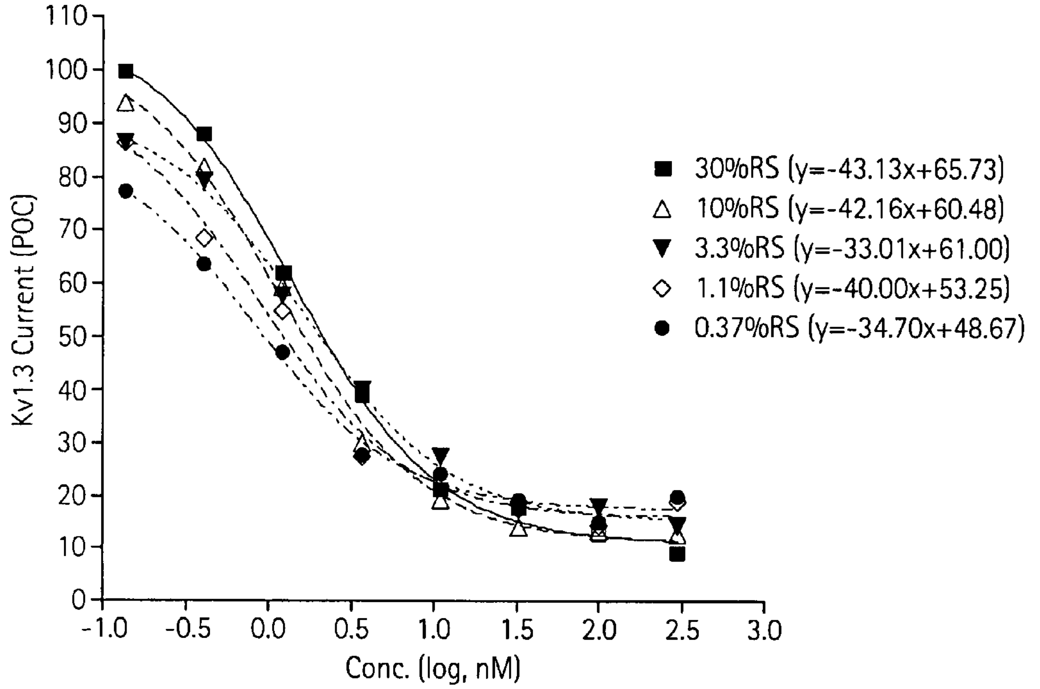

FIG. 58 shows Standard curves for ShK (FIG. 58A) and 20K PEG-ShK[1-35] (FIG. 58B) containing linear regression equations for each Standard at a given percentage of serum.

Figure 59:
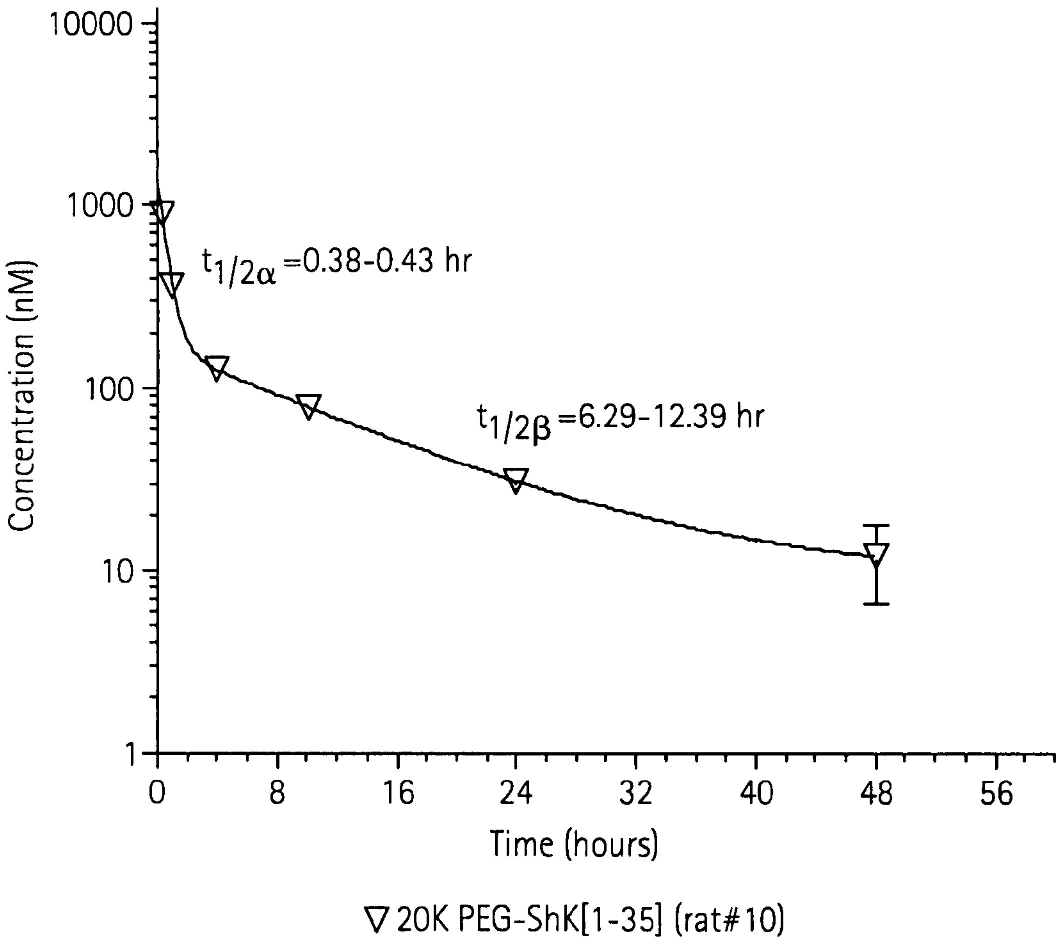

FIG. 59 shows the pharmacokinetic profile in rats of 20K PEG ShK[1-35] molecule after IV injection.

Figure 60:
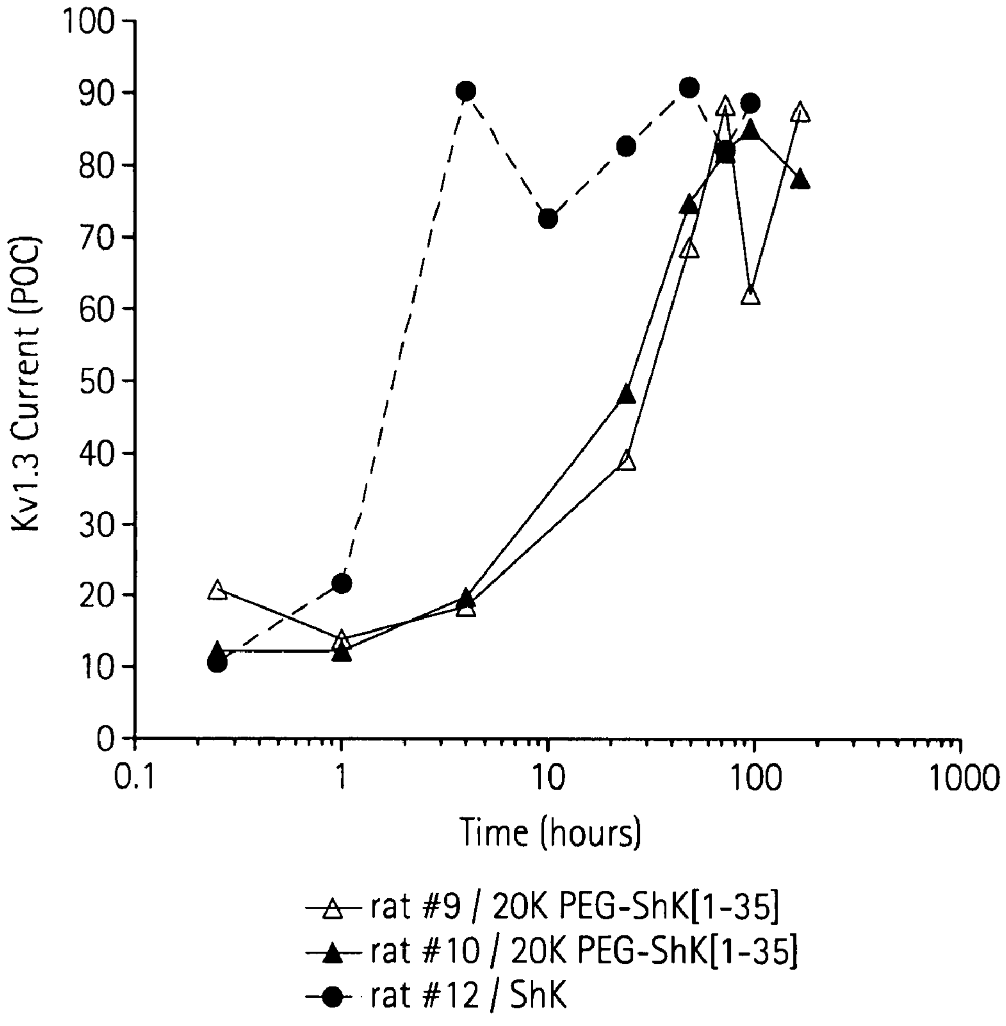

FIG. 60 shows Kv1.3 inhibitory activity in serum samples (5%) of rats receiving a single equal molar IV injection of Kv1.3 inhibitors ShK versus 20K PEG-ShK[1-35].

Figure 61:
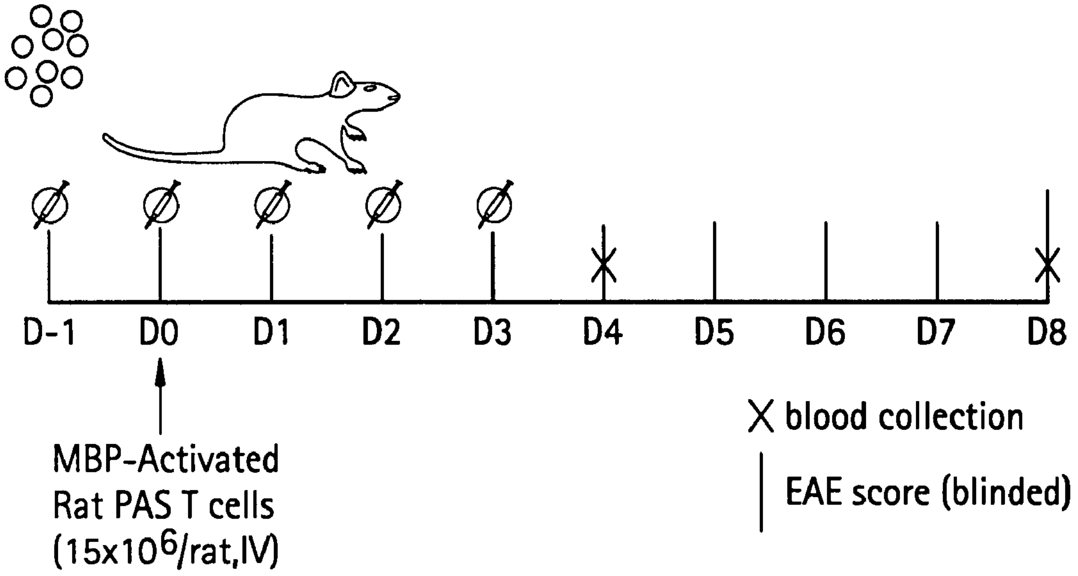

FIG. 61 illustrates an Adoptive Transfer EAE model experimental design (n=5 rats per treatment group). Dosing values in microgram per kilogram (mg/kg) are based on peptide content.

Figure 62:
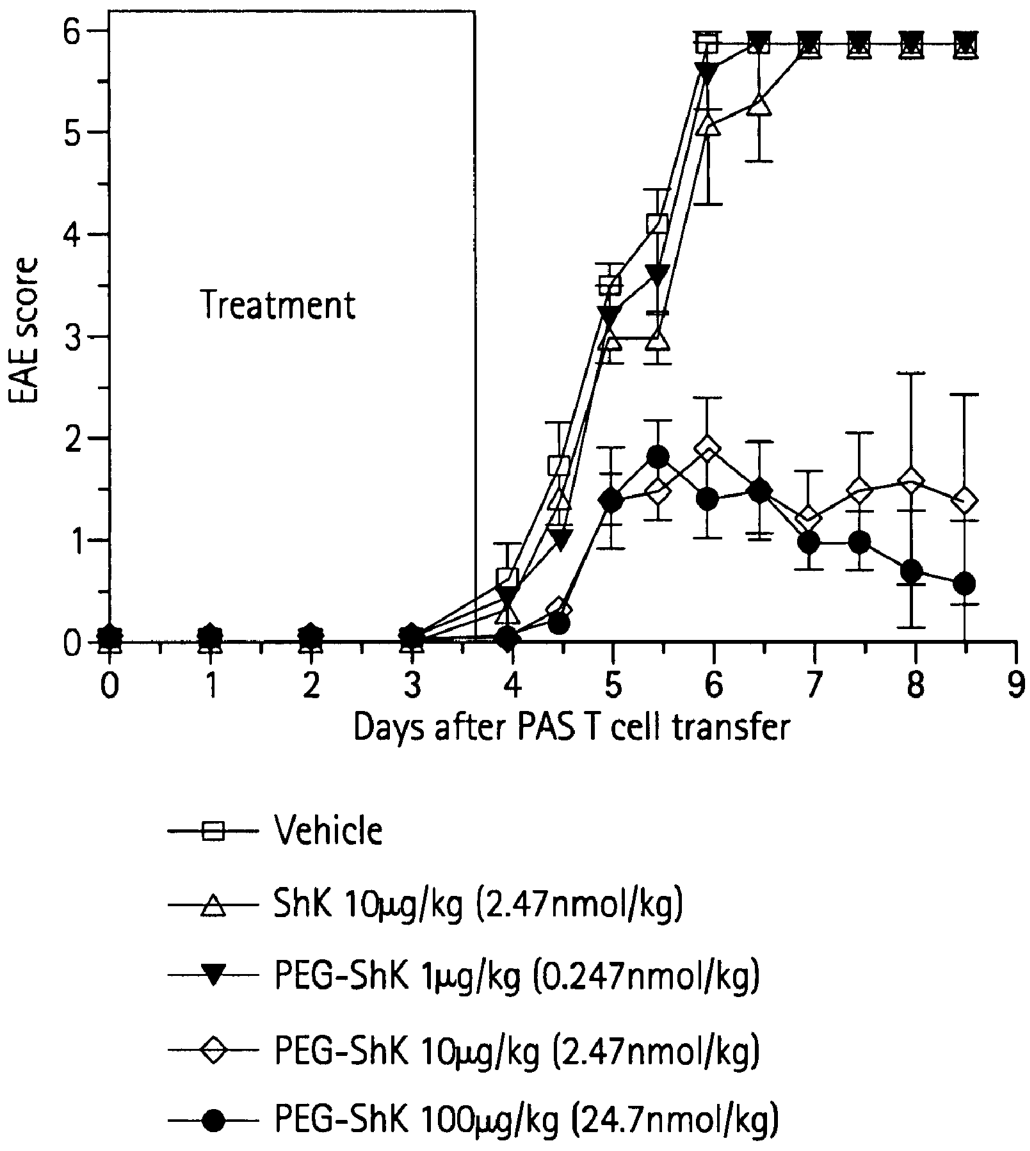

FIG. 62 shows that treatment with PEG-ShK ameliorated disease in rats in the adoptive transfer EAE model. Clinical scoring: 0=No signs, 0.5=distal limp tail, 1.0=limp tail, 2.0=mild paraparesis, ataxia, 3.0=moderate paraparesis, 3.5=one hind leg paralysis, 4.0=complete hind leg paralysis, 5.0=complete hind leg paralysis and incontinence, 5.5=tetraplegia, 6.0=moribund state or death. Rats reaching a score of 5.5 to 6 died or were euthanized. Mean±sem values are shown. (n=5 rats per treatment group.)

Figure 63:
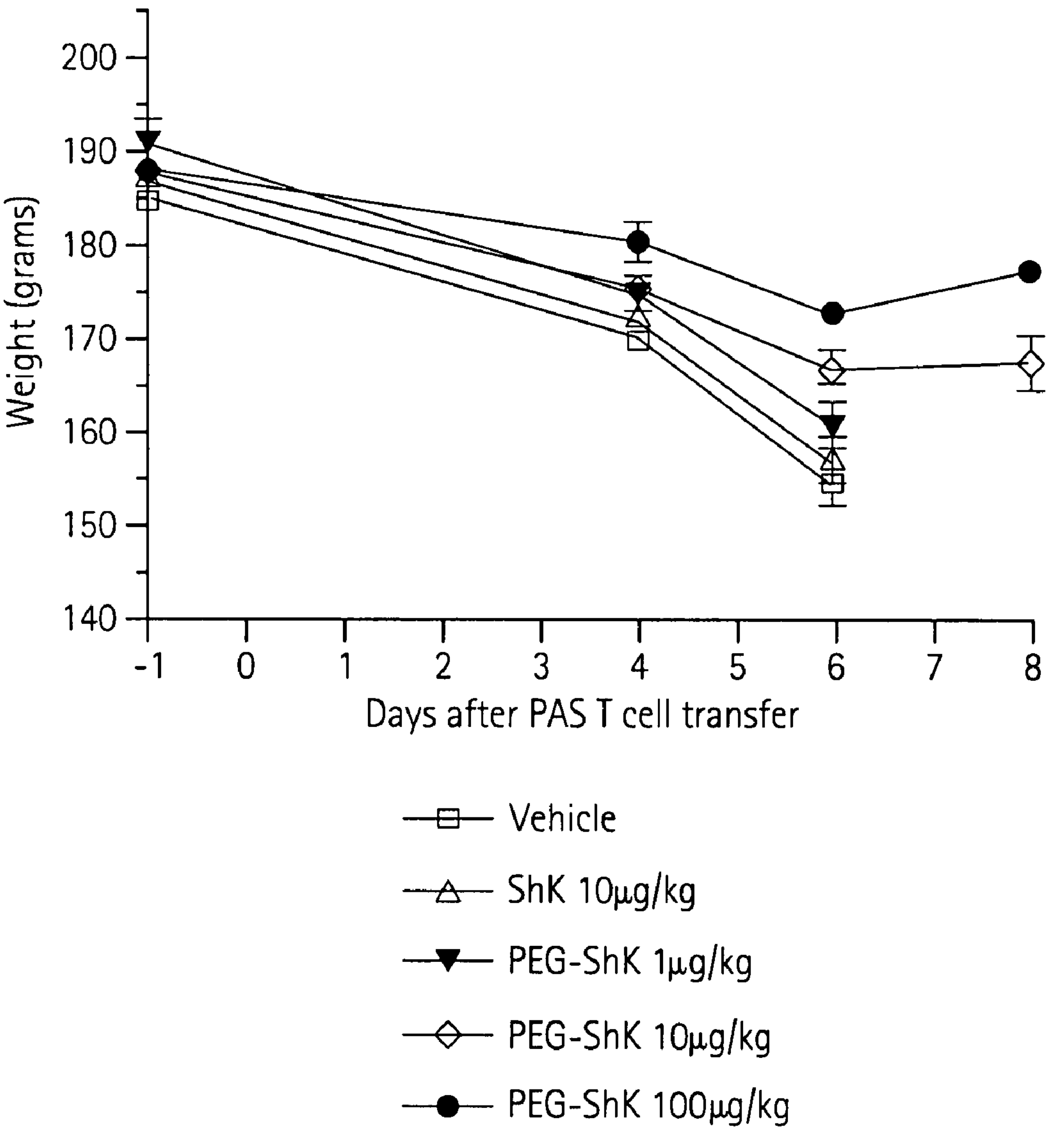

FIG. 63 shows that treatment with PEG-ShK prevented loss of body weight in the adoptive transfer EAE model. Rats were weighed on days −1, 4, 6, and 8 (for surviving rats). Mean±sem values are shown.

Figure 64A:
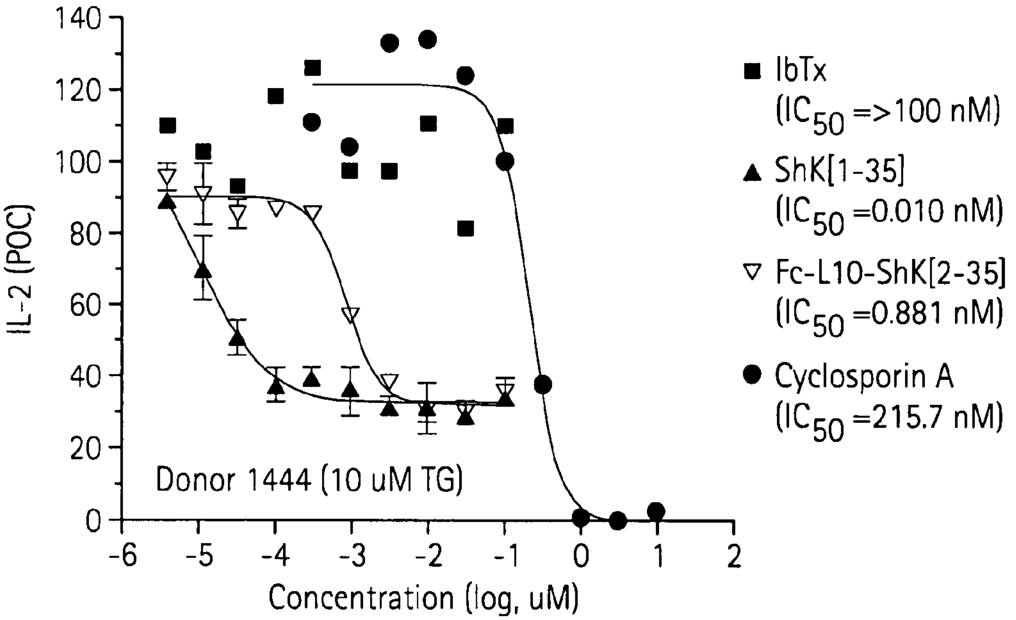
Figure 64B:
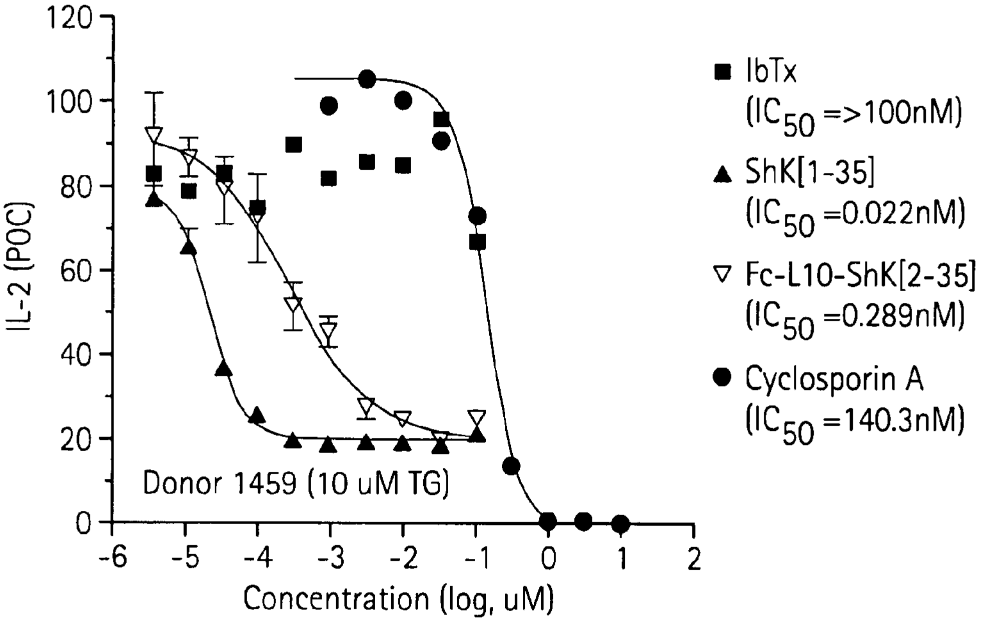

FIG. 64 shows that thapsigargin-induced IL-2 production in human whole blood was suppressed by the Kv1.3 channel inhibitors ShK[1-35] and Fc-L10-ShK[2-35]. The calcineurin inhibitor cyclosporine A also blocked the response. The BKCa channel inhibitor iberiotoxin (IbTx) showed no significant activity. The response of whole blood from two separate donors is shown in FIG. 64A and FIG. 64B.

FIG. 65 shows that thapsigargin-induced IFN-g production in human whole blood was suppressed by the Kv1.3 channel inhibitors ShK[1-35] and Fc-L10-ShK[2-35]. The calcineurin inhibitor cyclosporine A also blocked the response.

Figure 65A:
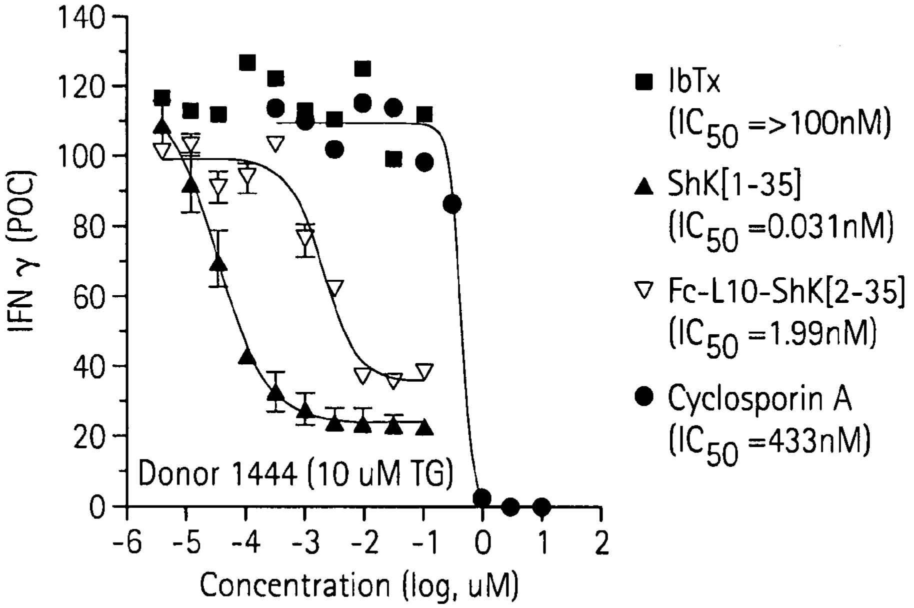
Figure 65B:
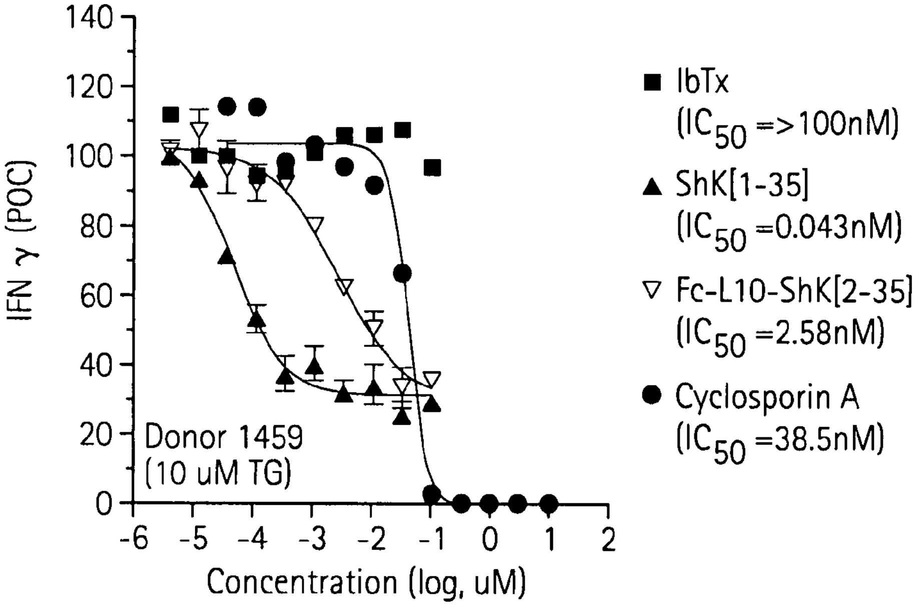

The BKCa channel inhibitor iberiotoxin (IbTx) showed no significant activity. The response of whole blood from two separate donors is shown in FIG. 65A and FIG. 65B.

Figure 66A:
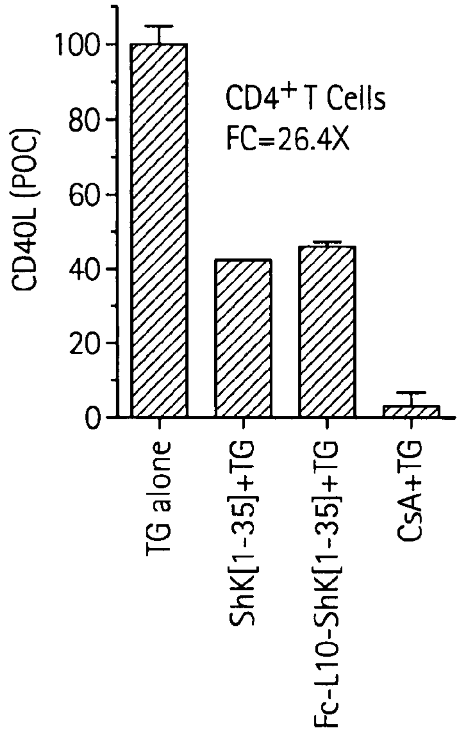
Figure 66B:
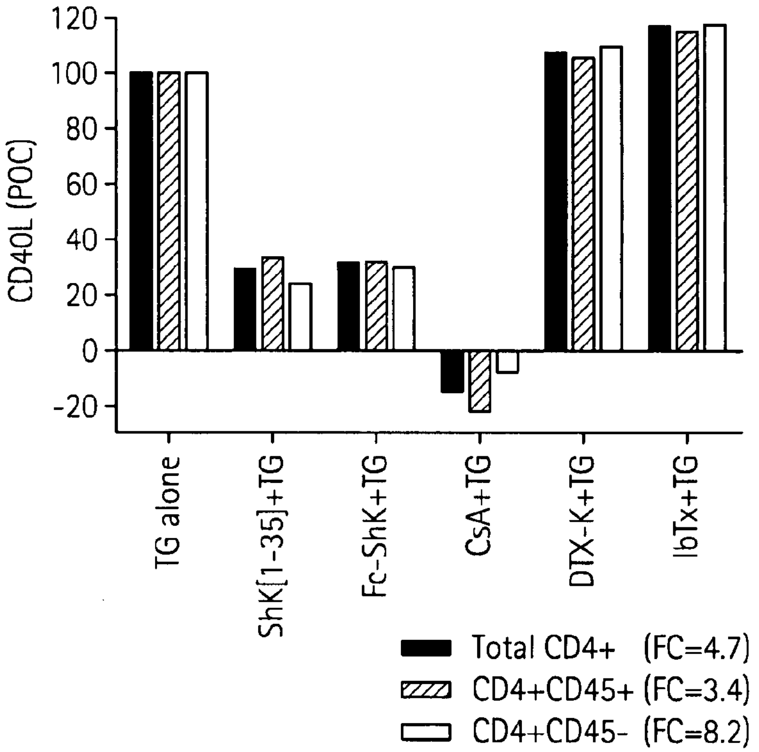

FIG. 66 shows that thapsigargin-induced upregulation of CD40L on T cells in human whole blood was suppressed by the Kv1.3 channel inhibitors ShK[1-35] and Fc-L10-ShK[1-35] (Fc-ShK). The calcineurin inhibitor cyclosporine A (CsA) also blocked the response. FIG. 66A shows results of an experiment looking at the response of total CD4+ T cells. FIG. 66B shows results of an experiment that looked at total CD4+ T cells, as well as CD4+CD45+ and CD4+CD45-T cells. In FIG. 66B, the BKCa channel inhibitor iberiotoxin (IbTx) and the Kv1.1 channel inhibitor dendrotoxin-K (DTX-K) showed no significant activity.

Figure 67A:
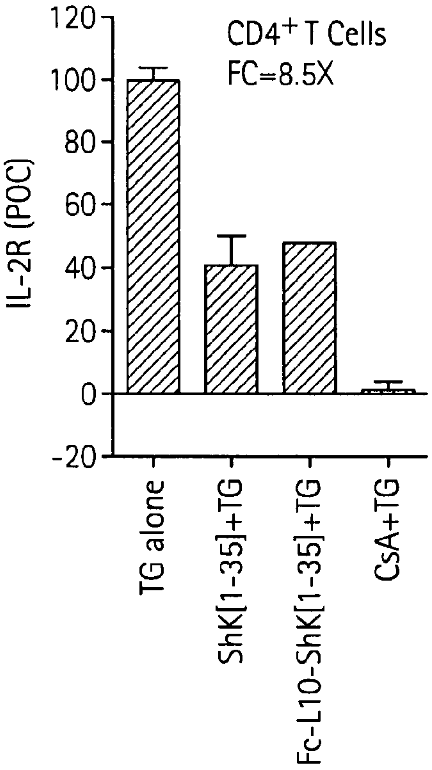
Figure 67B:
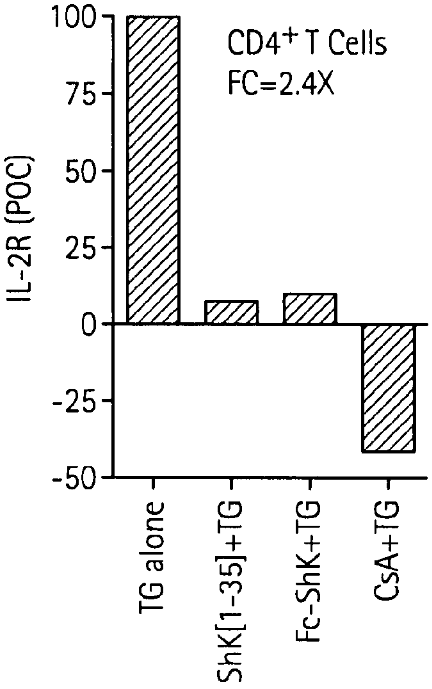

FIG. 67 shows that thapsigargin-induced upregulation of the IL-2R on T cells in human whole blood was suppressed by the Kv1.3 channel inhibitors ShK[1-35] and Fc-L10-ShK[1-35] (Fc-ShK). The calcineurin inhibitor cyclosporine A (CsA) also blocked the response. FIG. 67A shows results of an experiment looking at the response of total CD4+ T cells. FIG. 67B shows results of an experiment that looked at total CD4+ T cells, as well as CD4+CD45+ and CD4+CD45-T cells. In FIG. 67B, the BKCa channel inhibitor iberiotoxin (IbTx) and the Kv1.1 channel inhibitor dendrotoxin-K (DTX-K) showed no significant activity.

Figure 68A:
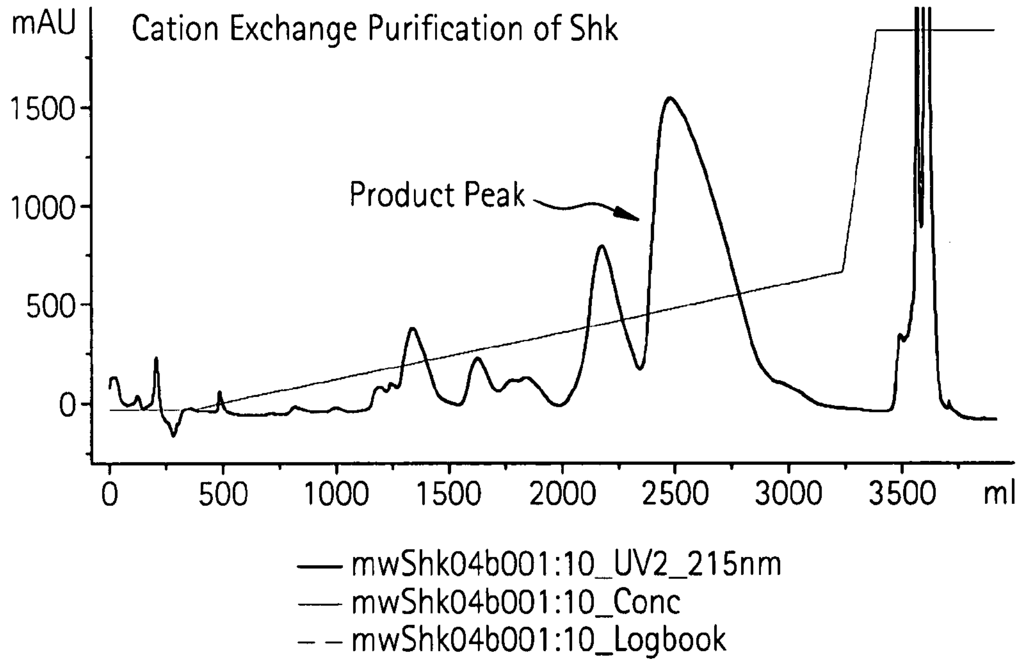
Figure 68B:
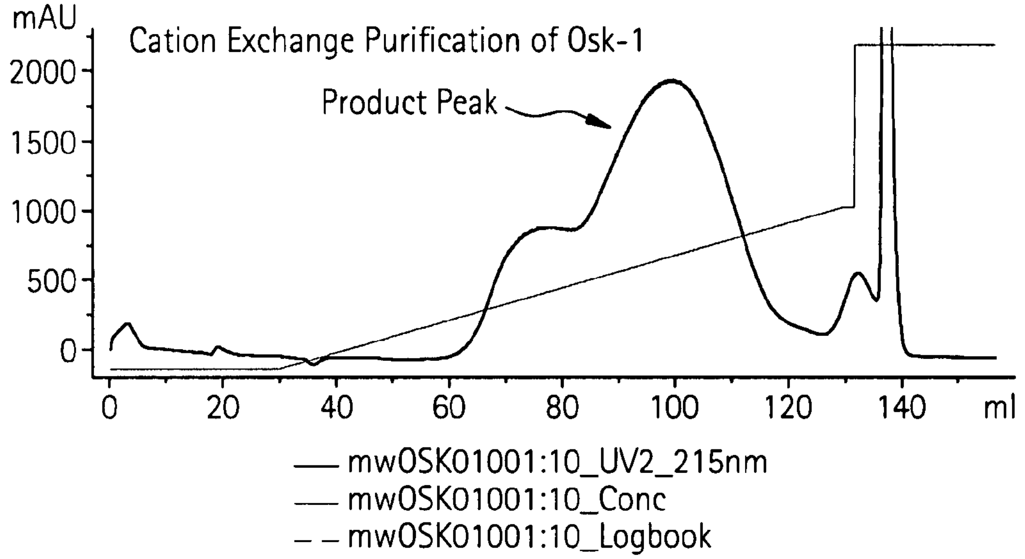

FIG. 68 shows cation exchange chromatograms of PEG-peptide purification on SP Sepharose HP columns for PEG-Shk purification (FIG. 68A) and PEG-OSK-1 purification (FIG. 68B).

Figure 69A:
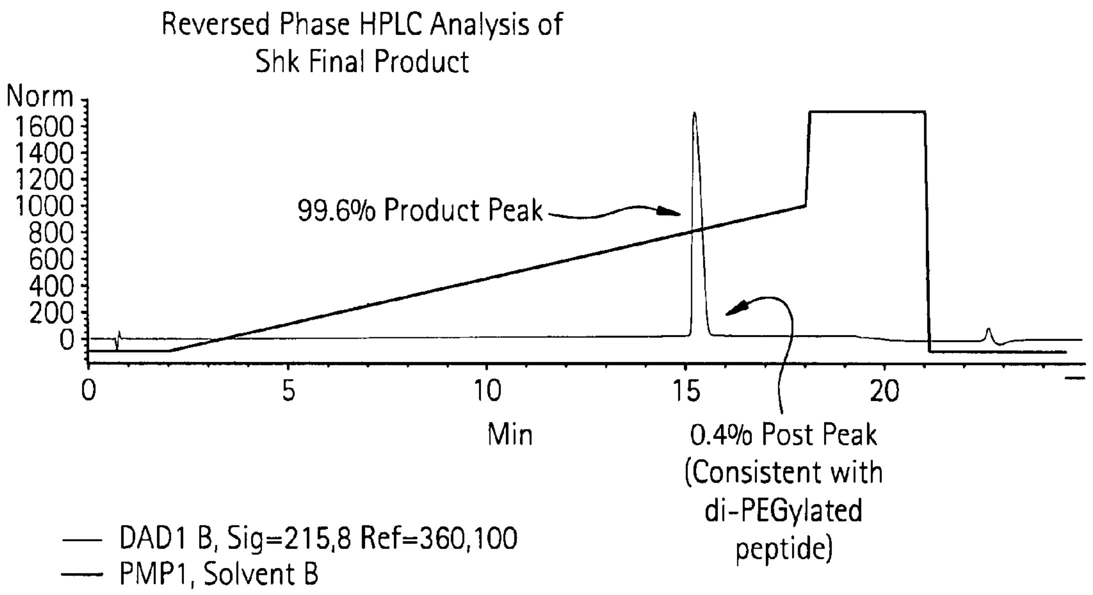
Figure 69B:
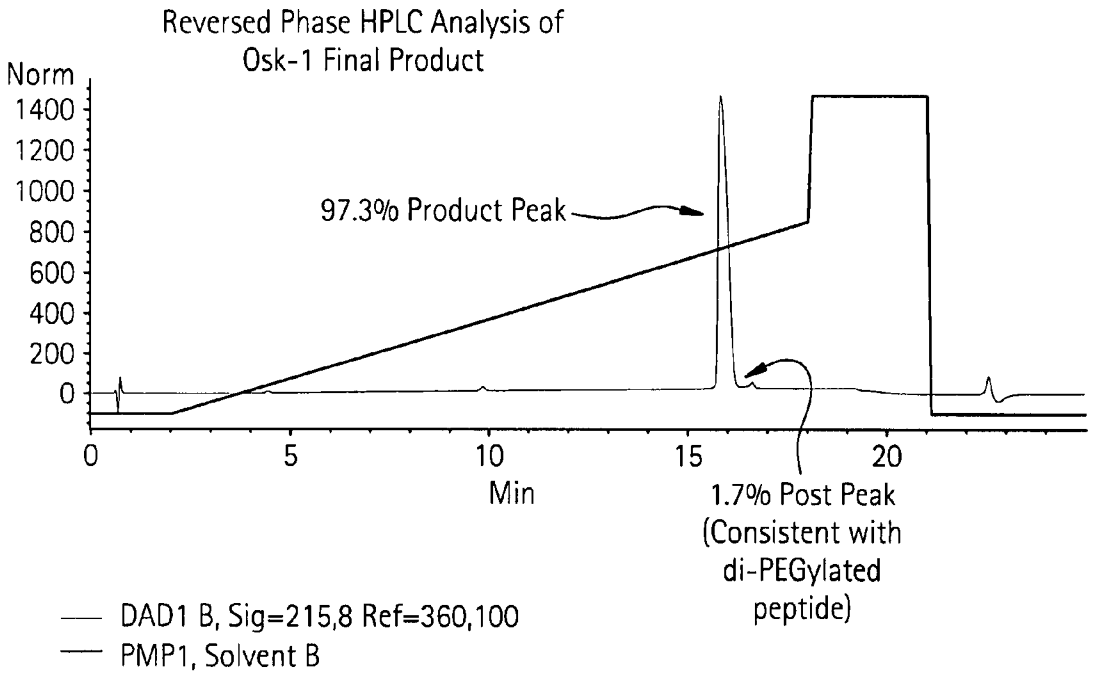

FIG. 69 shows RP-HPLC chromatograms on final PEG-peptide pools to demonstrate purity of PEG-Shk purity >99% (FIG. 69A) and PEG-Osk1 purity >97% (FIG. 69B).

FIG. 70 shows the amino acid sequence (SEQ ID NO: 976) of an exemplary FcLoop-L2-OsK1-L2 having three linked domains: Fc N-terminal domain (amino acid residues 1-139); OsK1 (underlined amino acid residues 142-179); and Fc C-terminal domain (amino acid residues 182-270).

FIG. 71 shows the amino acid sequence (SEQ ID NO: 977) of an exemplary FcLoop-L2-ShK-L2 having three linked domains: Fc N-terminal domain (amino acid residues 1-139); ShK (underlined amino acid residues 142-176); and Fc C-terminal domain (amino acid residues 179-267).

FIG. 72 shows the amino acid sequence (SEQ ID NO: 978) of an exemplary FcLoop-L2-ShK-L4 having three linked domains: Fc N-terminal domain (amino acid residues 1-139); ShK (underlined amino acid residues 142-176); and Fc C-terminal domain (amino acid residues 181-269).

FIG. 73 shows the amino acid sequence (SEQ ID NO: 979) of an exemplary FcLoop-L4-OsK1-L2 having three linked domains: Fc N-terminal domain (amino acid residues 1-139); OsK1(underlined amino acid residues 144-181); and Fc C-terminal domain (amino acid residues 184-272).

Figure 74:
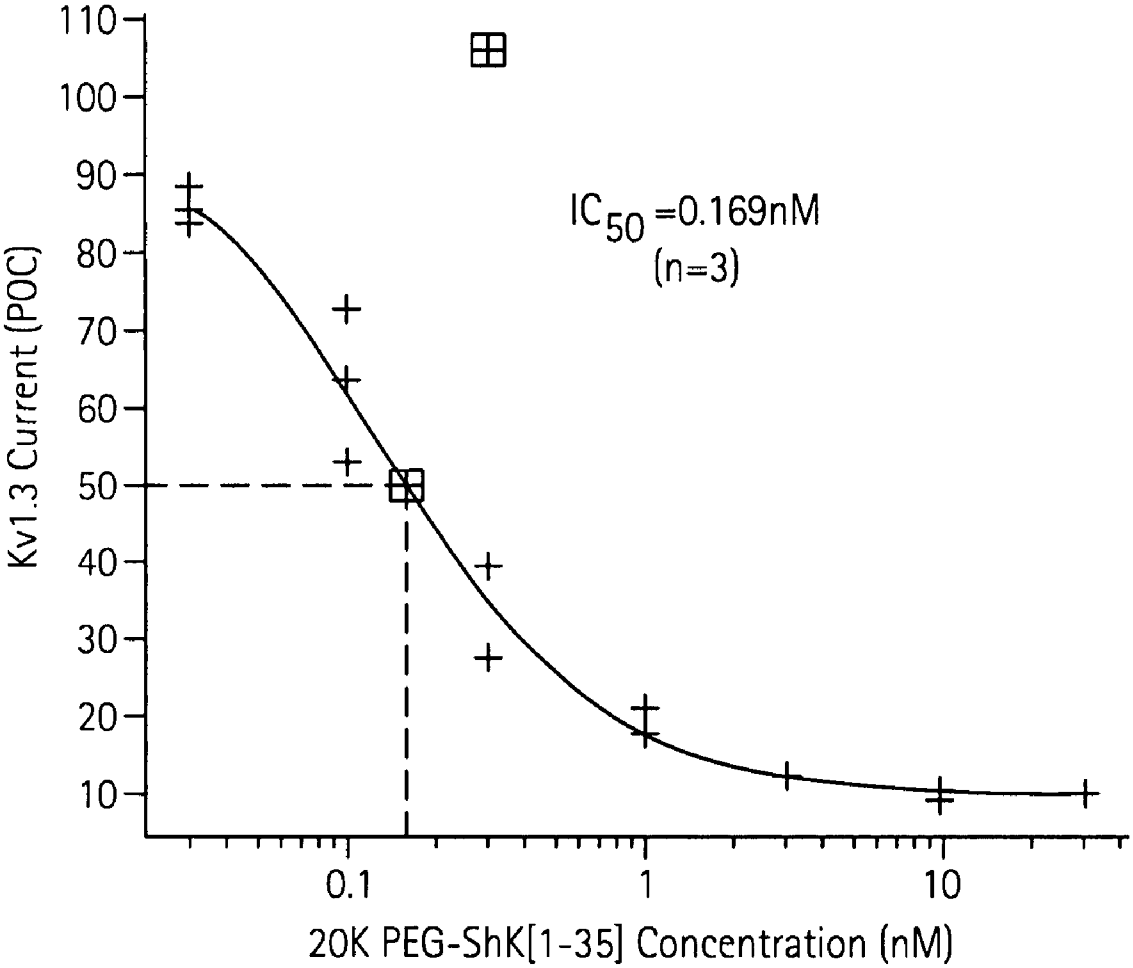

FIG. 74 shows that the 20K PEGylated ShK[1-35] provided potent blockade of human Kv1.3 as determined by whole cell patch clamp electrophysiology on HEK293/Kv1.3 cells. The data represents blockade of peak current.

FIG. 75 shows schematic structures of some other exemplary embodiments of the composition of matter of the invention. "$X^2$" and "$X^3$" represent toxin peptides or linker-toxin peptide combinations (i.e., $-(L)_f-P-(L)_g-$) as defined herein. As described herein but not shown in FIG. 75, an additional $X^1$ domain and one or more additional PEG moieties are also encompassed in other embodiments. The specific embodiments shown here are as follows:

FIG. 75C, FIG. 75D, FIG. 75G and FIG. 75H: show a single chain molecule and can also represent the DNA construct for the molecule.

Figure 75A:
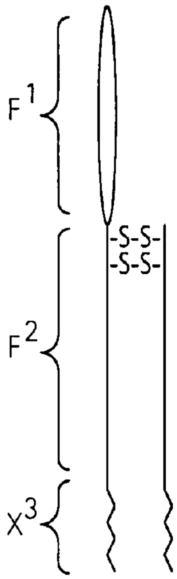
Figure 75B:
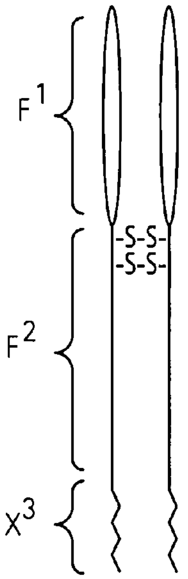
Figure 75C:
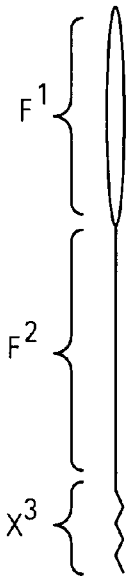
Figure 75D:
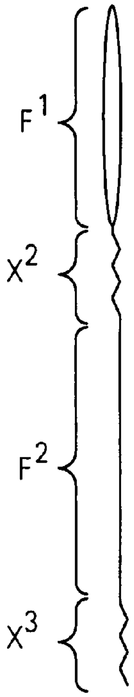
Figure 75E:
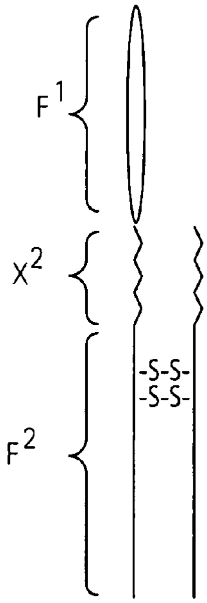
Figure 75F:
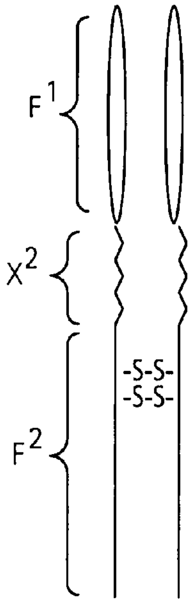
Figure 75G:
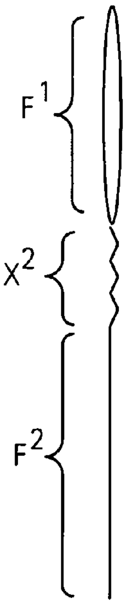
Figure 75H:
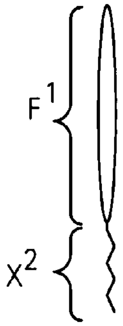

FIG. 75A, FIG. 75B, FIG. 75E and FIG. 75F: show doubly disulfide-bonded Fc dimers (in position $F^2$); FIG. 75A and FIG. 75B show a dimer having the toxin peptide portion on both chains in position $X^3$; FIG. 75E and FIG. 75F show a dimer having the toxin peptide portion on both chains In position $X^2$.

Figure 76A:
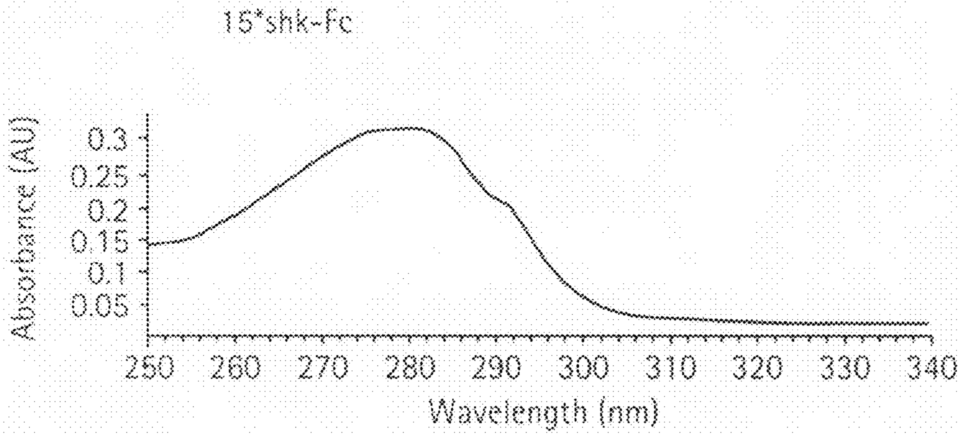

FIG. 76A shows a spectral scan of 50 μl of the ShK[2-35]-Fc product diluted in 700 μl PBS (blanking buffer) using a Hewlett Packard 8453 spectrophotometer and a 1 cm path length quartz cuvette.

Figure 76B:
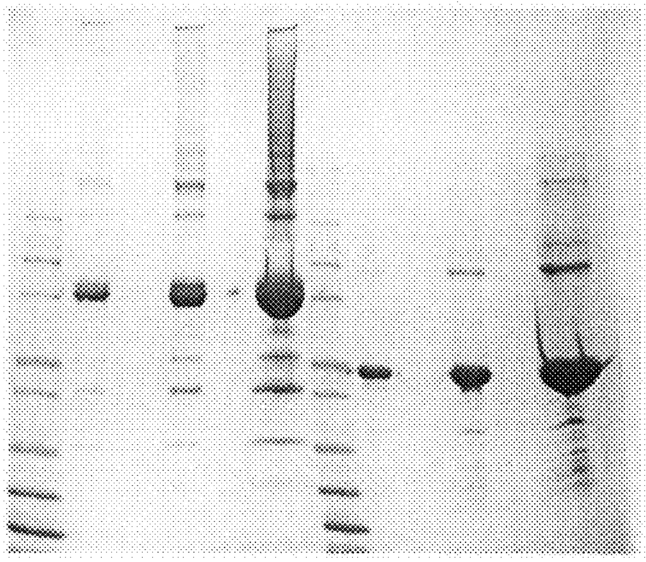

FIG. 76B shows Coomassie brilliant blue stained tris-glycine 4-20% SDS-PAGE of the final ShK[2-35]-Fc product. Lanes 1-12 were loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 76C:
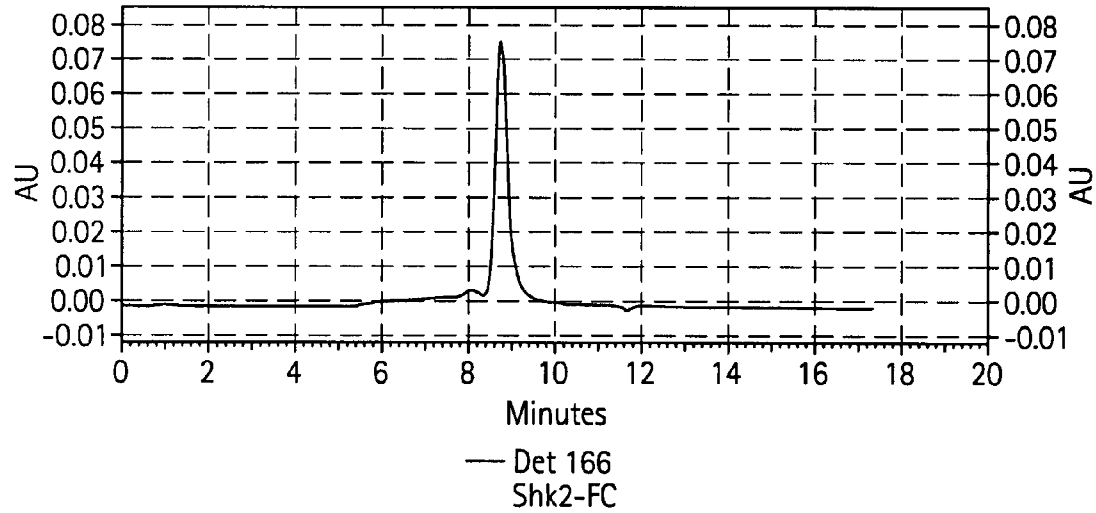

FIG. 76C shows size exclusion chromatography on 70 μg of the final ShK[2-35]-Fc product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 76D:
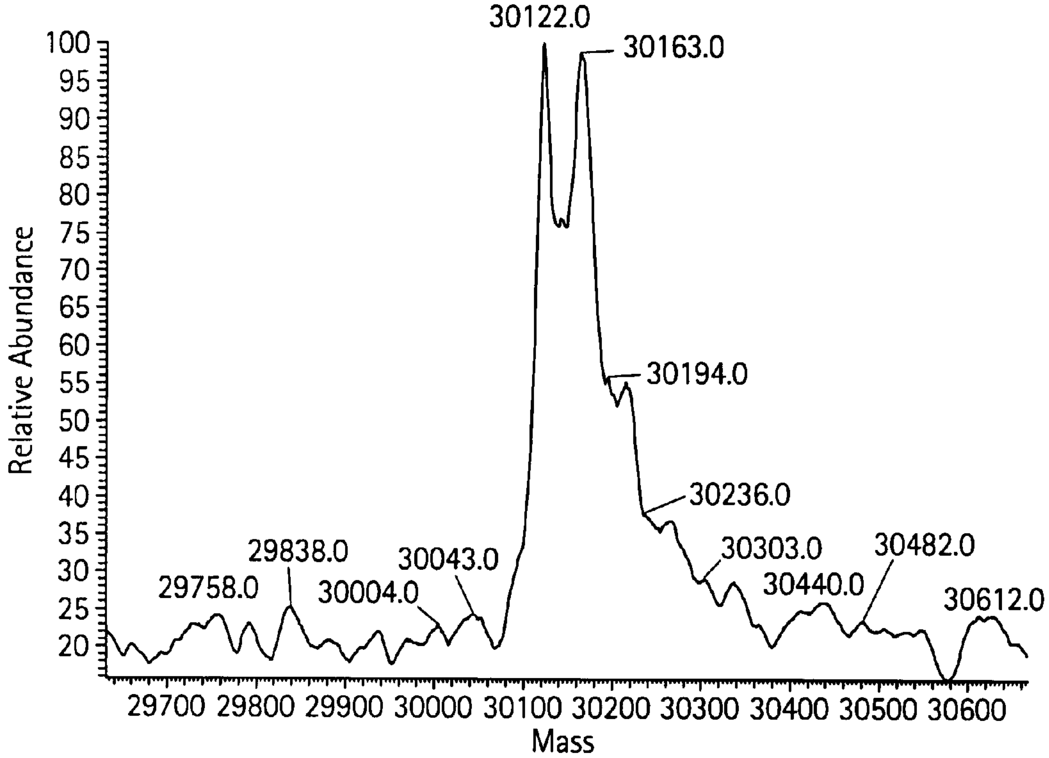

FIG. 76D shows LC-MS analysis of the final ShK[2-35]-Fc sample using an Agilent 1100 HPCL running reverse phase chromatography, with the column effluent directly coupled to an electrospray source of a Thermo Finnigan LCQ ion trap mass spectrometer. Relevant spectra were summed and deconvoluted to mass data with the Bioworks software package.

Figure 77A:
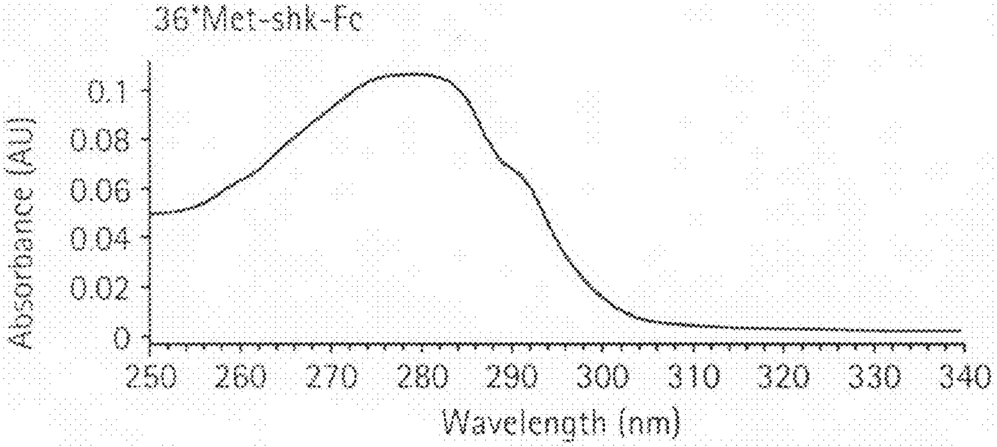

FIG. 77A shows a spectral scan of 20 μl of the met-ShK [1-35]-Fc product diluted in 700 μl PBS (blanking buffer) using a Hewlett Packard 8453 spectrophotometer and a 1 cm path length quartz cuvette.

Figure 77B:
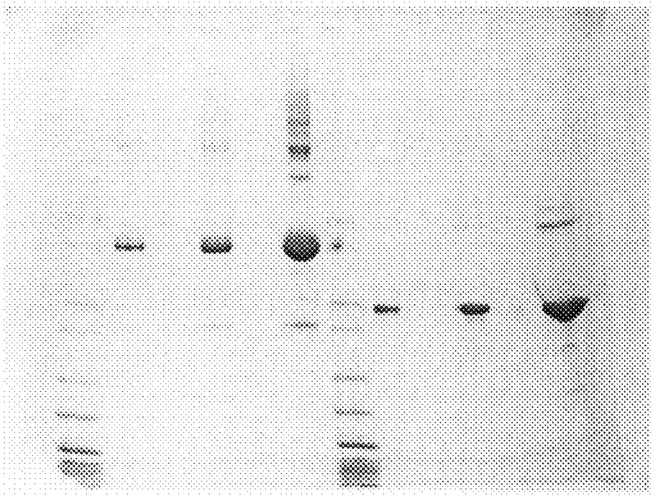

FIG. 77B shows Coomassie brilliant blue stained tris-glycine 4-20% SDS-PAGE of the final met-ShK[1-35]-Fc product. Lanes 1-12 were loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.

Figure 77C:
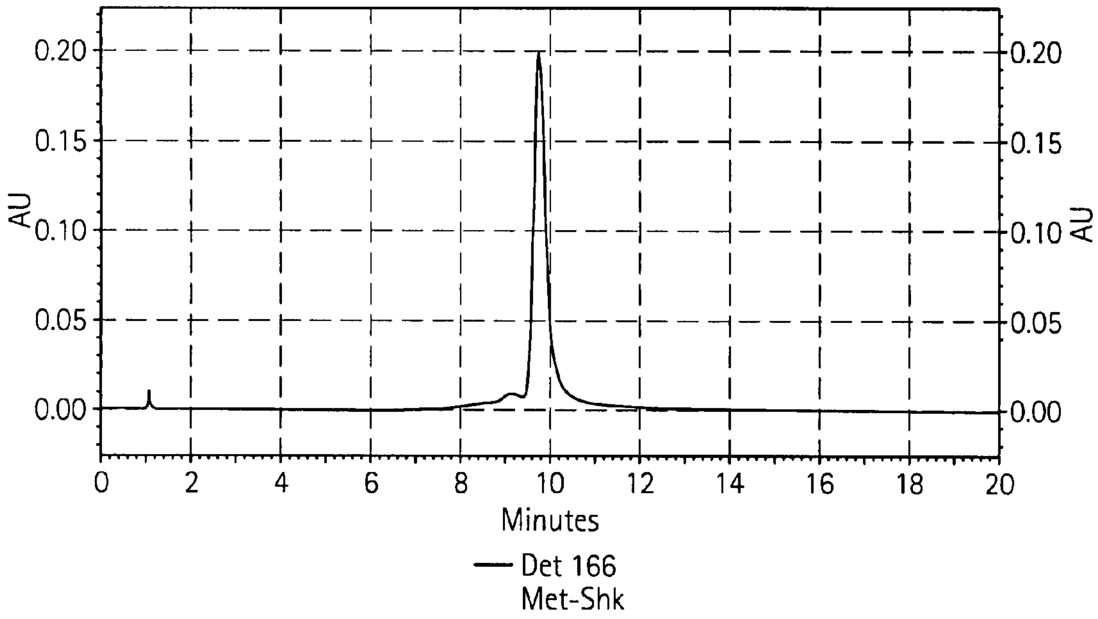

FIG. 77C shows size exclusion chromatography on 93 μg of the final met-ShK[1-35]-Fc product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 77D:
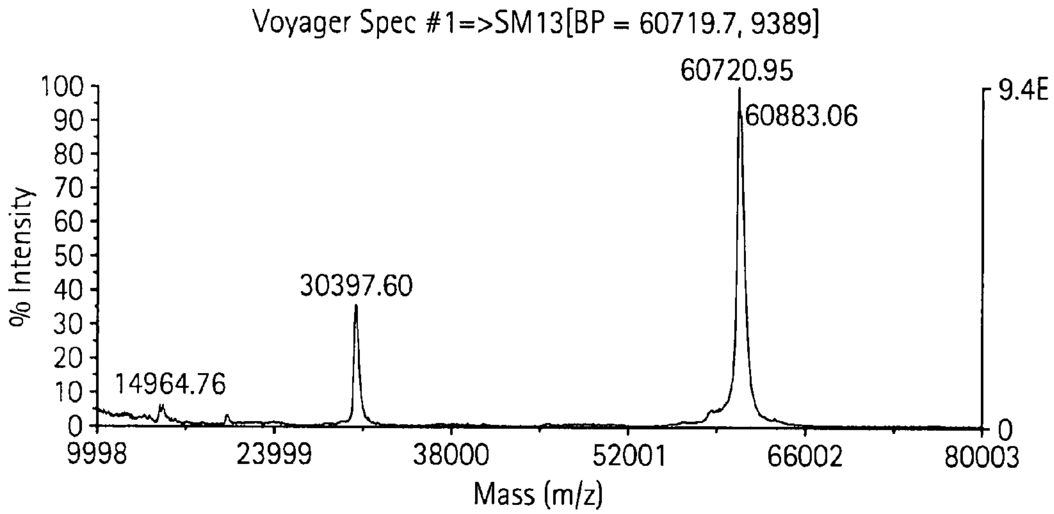

FIG. 77D shows MALDI mass spectral analysis of the final met-ShK[1-35]-Fc sample analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

Figure 78:
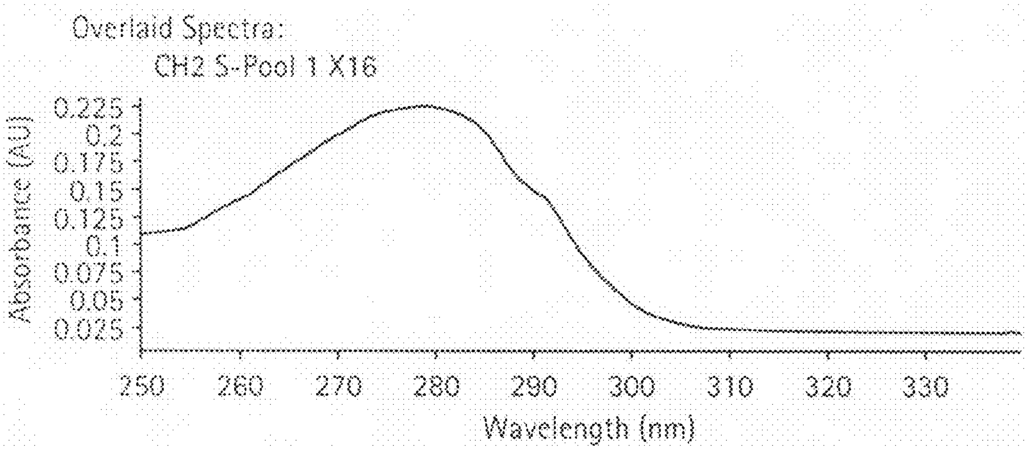

FIG. 78 shows a spectral scan of 10 μl of the CH2-OSK1 fusion protein product diluted in 150 μl water (blanking buffer) using a Hewlett Packard 8453 spectrophotometer and a 1 cm path length quartz cuvette.

Figure 79:
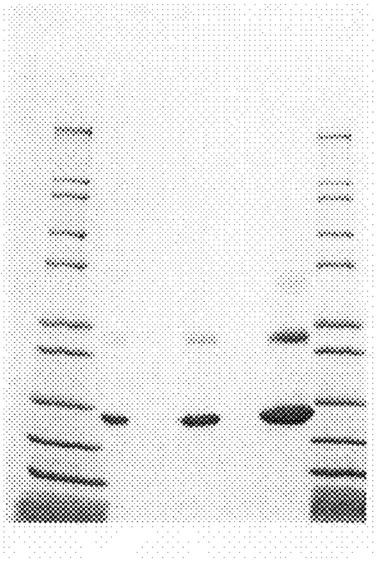

FIG. 79 shows Coomassie brilliant blue stained tris-glycine 4-20% SDS-PAGE of the final CH2-OSK1 fusion protein product. Lane 1-7 were loaded as follows: Novex Mark12 wide range protein standards, 0.5 μg product non-reduced, blank, 2.0 μg product non-reduced, blank, 10 μg product non-reduced, and Novex Mark12 wide range protein standards.

Figure 80:
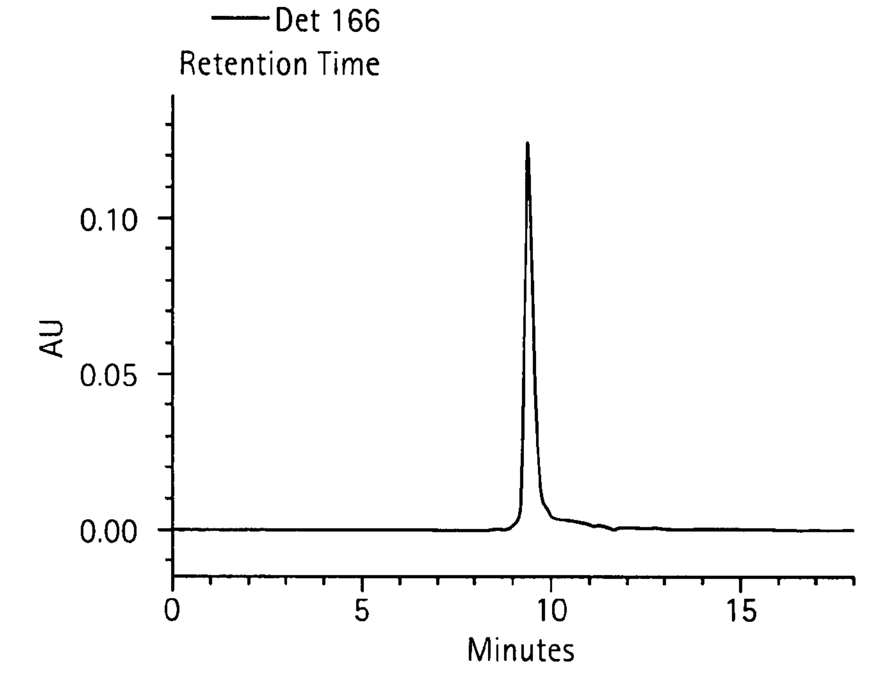

FIG. 80 shows size exclusion chromatography on 50 μg of the final CH2-OSK1 fusion protein product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.

Figure 81:
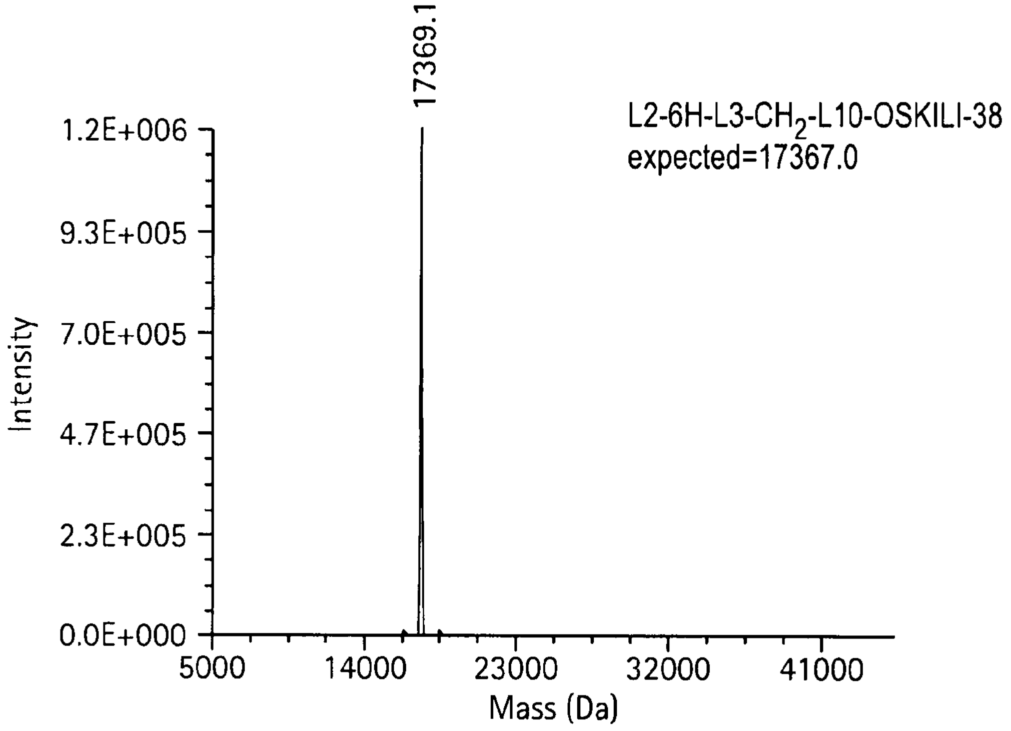

FIG. 81 shows liquid chromatography—mass spectral analysis of the CH2-OSK1 fusion protein sample using a Vydac $C_4$ column with part of the effluent directed into a LCQ ion trap mass spectrometer. The mass spectrum was deconvoluted using the Bioworks software provided by the mass spectrometer manufacturer.

Figure 82:
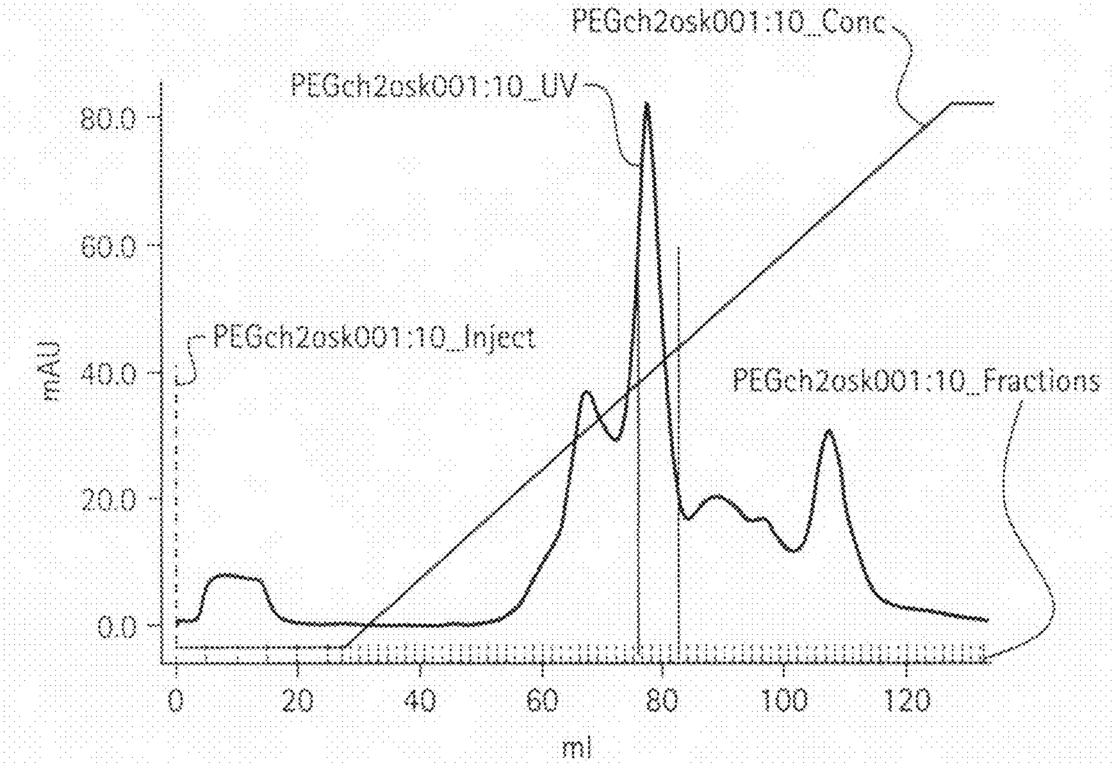

FIG. 82 shows cation exchange chromatogram of PEG-CH2-OSK1 reaction mixture. Vertical lines delineate fractions pooled to obtain mono-PEGylated CH2-OSK1.

Figure 83:
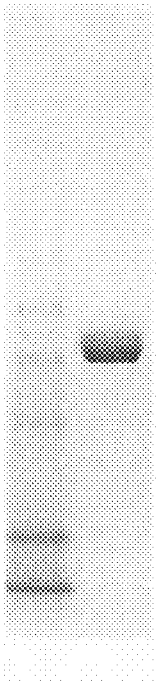

FIG. 83 shows Coomassie brilliant blue stained tris-glycine 4-20% SDS-PAGE of the final PEGylated CH2-OSK1 pool. Lane 1-2 were loaded as follows: Novex Mark12 wide range protein standards, 2.0 μg product non-reduced.

Figure 84:
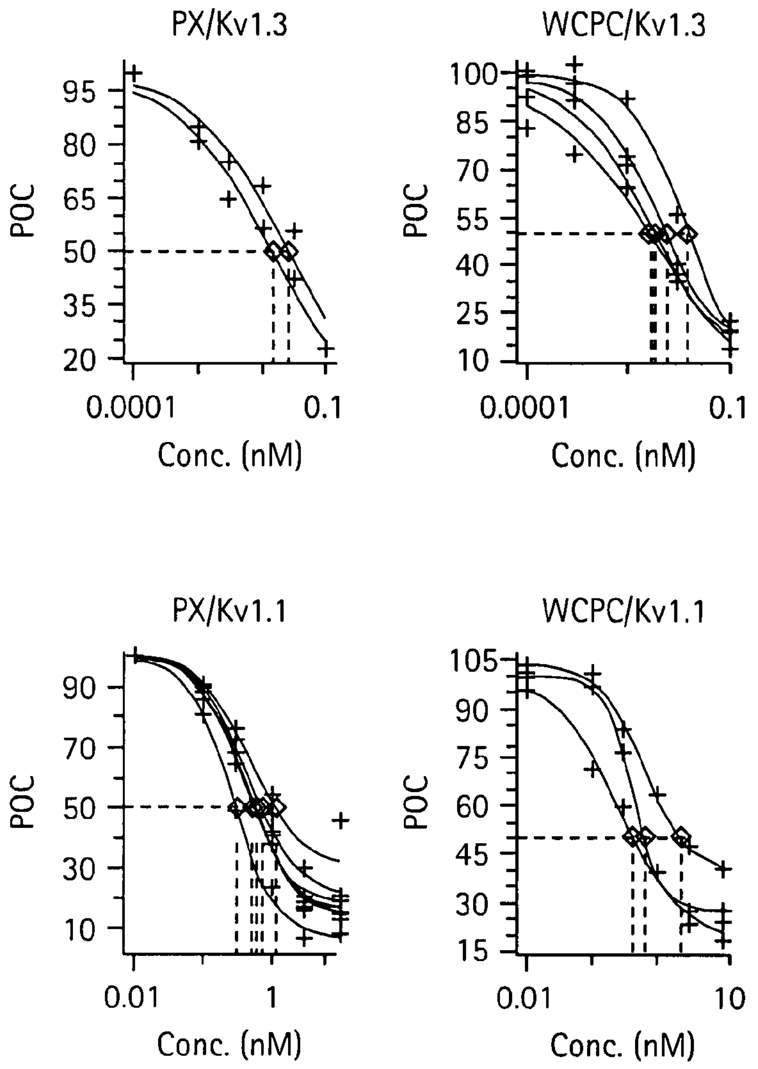

FIG. 84 shows whole cell patch clamp (WCPC) and PatchXpress (PX) electrophysiology comparing the activity of OSK1[Ala-12] (SEQ ID No:1410) on human Kv1.3 and human Kv1.1 heterologously overexpressed on CHO and HEK293 cells, respectively. The table summarizes the calculated $IC_{50}$ values and the plots show the individual traces of the impact of various concentrations of analog on the relative Kv1.3 or Kv1.1 current (percent of control, POC).

Figure 85:
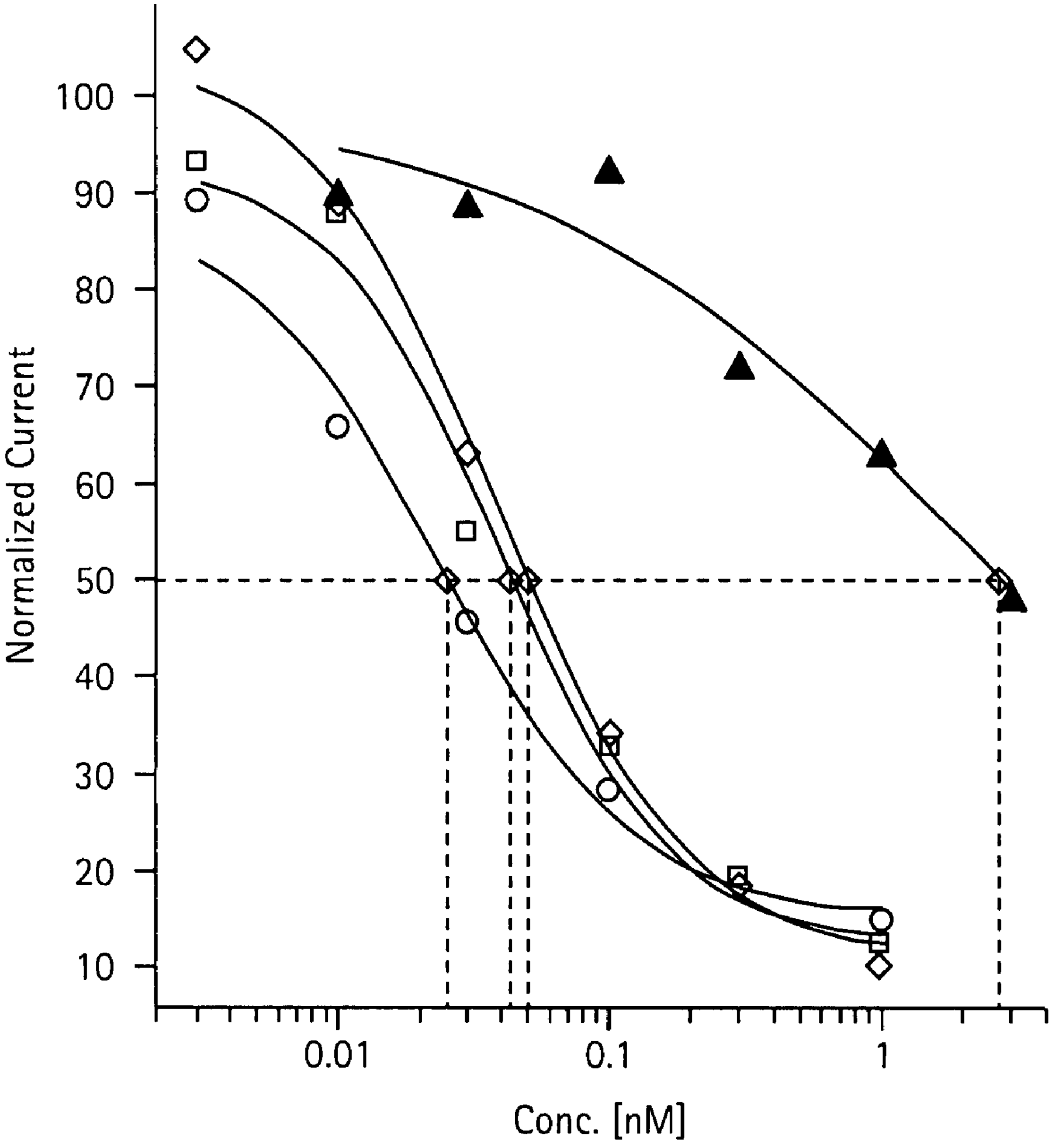

FIG. 85 shows whole cell patch clamp electrophysiology comparing the activity of OSK1[Ala-29] (SEQ ID No:1424) on human Kv1.3 and human Kv1.1 heterologously overexpressed on CHO and HEK293 cells, respectively. Concentration response curves of OSK1[Ala-29] on CHO/Kv1.3 (circle, square and diamond, $IC_{50}$=0.033 nM, n=3) and on HEK/Kv1.1 (filled triangle, $IC_{50}$=2.7 nM, n=1).

Figure 86A:
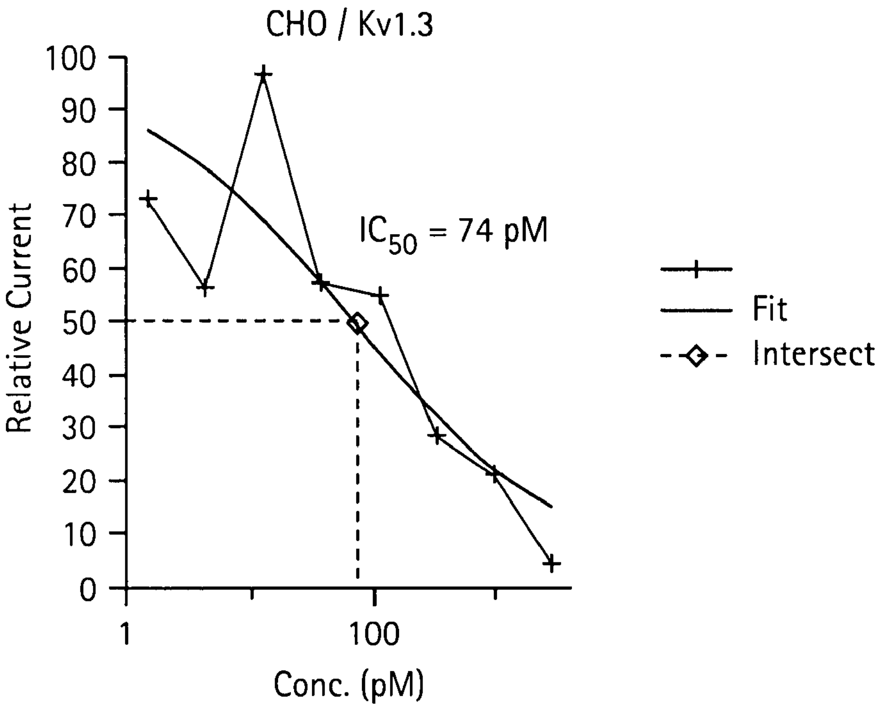
Figure 86B:
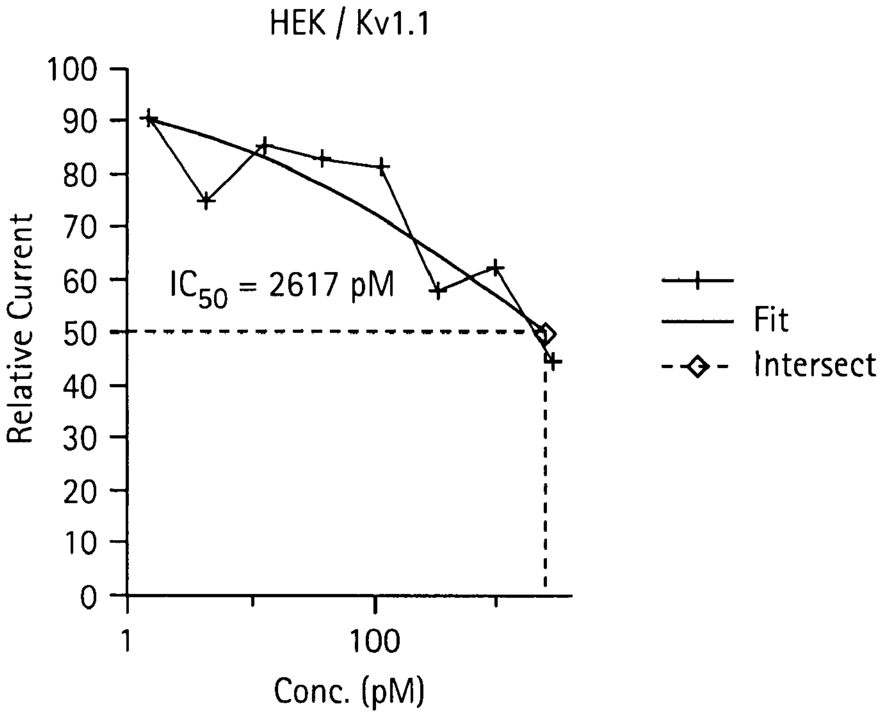

FIG. 86 shows a dose-response curve for OSK1[Ala-29] (SEQ ID No:1424) against human Kv1.3 (CHO) (panel A) and human Kv1.1 (HEK293) (panel B) as determined by high-throughput 384-well planar patch clamp electrophysiology using the IonWorks Quattro system.

Figure 87A:
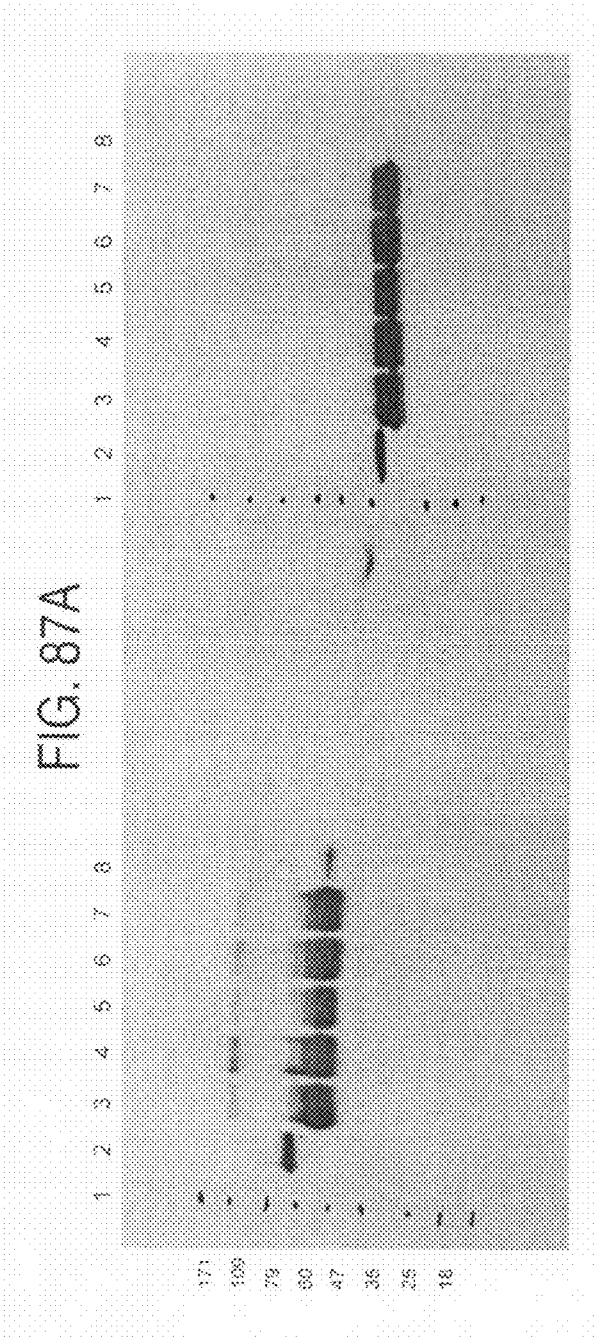
Figure 87B:
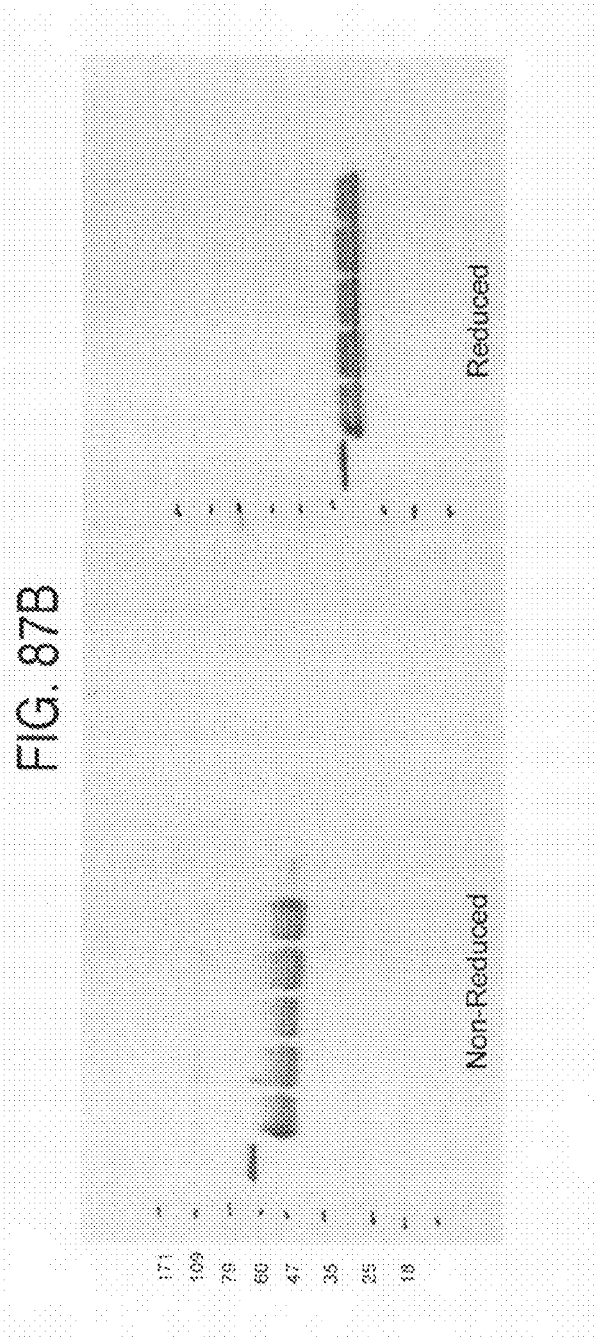

FIG. 87A-B show Western blots of Tris-glycine 4-20% SDS-PAGE (FIG. 87A with longer exposure time and FIG. 87B with shorter exposure time) of a monovalent dimeric Fc-L-ShK(2-35) molecule product expressed by and released into the conditioned media from mammalian cells transiently transfected with pTT5-Fc-Fc-L10-Shk(2-35), which was sampled after the indicated number of days. Lanes 3-8 were loaded with 20 μL of conditioned medium per lane. The immunoblot was probed with anti-human IgG-Fc-HRP (Pierce). The lanes were loaded as follows: 1) MW Markers; 2) purified Fc-L10-ShK(2-35), 10 ng; 3) 293-6E-HD (5-day); 4) 293-6E-HD (6-day); 5) 293-6E-PEI (5-day); 6) 293-6E-PEI (6-day); 7) CHO-S (5-day); 8) CHO-S (6-day). Four bands were expected in the reduced gel: Linker-Fc-Shk(2-35) (one cut at 3' furin site; predicted MW: 33.4 kDa); Fc-ShK (2-35) (both furin sites cut; predicted MW: 30.4 kDa); Fc-linker (one cut at 5' furin site; predicted MW: 29.1 kDa); Fc (both furin sites cut; predicted MW: 25.8 kDa). Further mass spec or amino acid sequence analysis of the individual bands is needed to identify these bands and their relative ratios.

Figure 88:
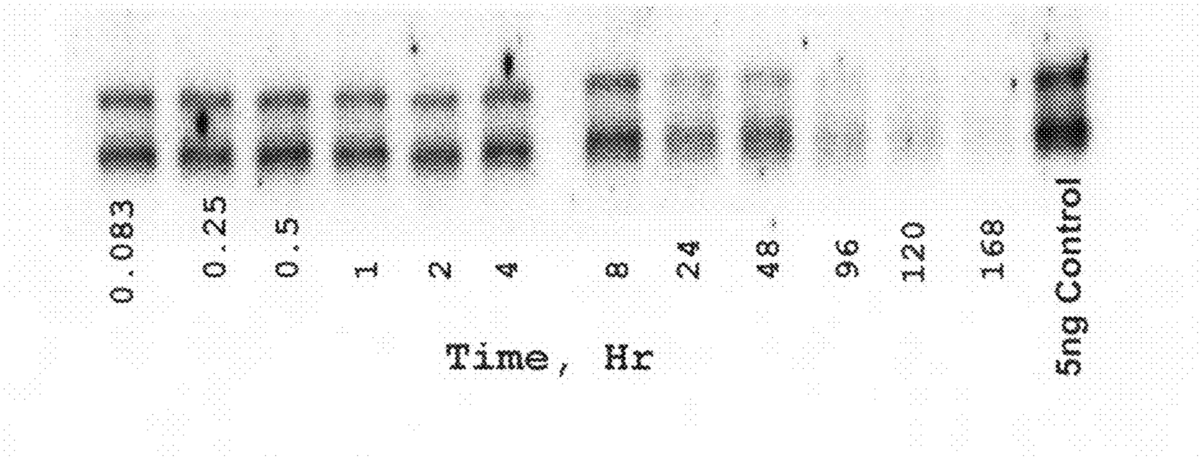

FIG. 88 shows a western blot of serum samples from a pharmacokinetic study on monovalent dimeric Fc-ShK(1-35) in SD rats. Various times (0.083-168 hours) after a single 1 mg/kg intravenous injection of monovalent dimeric Fc-L10-ShK(1-35) (see, Example 2), blood was drawn, and serum was collected. A Costar EIA/RIA 96 well plate was coated with 2 μg/ml polyclonal goat anti-human Fc antibody overnight at 4° C. Capture antibody was removed and the plate was washed with PBST and then blocked with Blotto. After the plate was washed, serum samples diluted in PBST/0.1% BSA were added. Binding was allowed to occur at room temperature for several hours, and then the plate was again washed. Samples were eluted from the plate with reducing Laemmle buffer, heated, then run on SDS-Page gels. Run in an adjacent lane ("5 ng Control") of the gel as a standard was 5 ng of the purified monovalent dimeric Fc-L10-ShK(1-35) fusion protein used in the pharmacokinetic study. Proteins were transferred to PVDF membranes by western blot. Membranes were blocked with Blotto followed by incubation with goat anti-Human Fc-HRP conjugated antibody. After the membranes were washed, signal was detected via chemiluminescence using a CCD camera.

FIG. 89 shows the NMR solution structure of OSK1 and sites identified by analoging to be important for Kv1.3 activity and selectivity. Space filling structures are shown in FIGS. 89A, 89B and 89D. The color rendering in FIG. 89A depicts amino acid charge. In FIG. 89B, several key OSK1 amino acid residues found to be important for Kv1.3 activity (Tables 37-40) are lightly shaded and labeled Phe25, Gly26, Lys27, Met29 and Asn30. In FIG. 89D residues Ser11, Met29 and His34 are labeled. Some analogues of these residues were found to result in improved Kv1.3 selectivity over Kv1.1 (Tables 41). FIG. 89C shows the three beta strands and single alpha helix of OSK1. The amino acid sequence of native OSK1 (SEQ ID No: 25) is shown in FIG. 89E, with residues forming the molecules beta strands (β1, β2, β3) and alpha helix (al) underlined. The OSK1 structures shown were derived from PDB:1SCO, and were rendered using Cn3D vers4.1.

FIG. 90A-D illustrates that toxin peptide inhibitors of Kv1.3 provide potent blockade of the whole blood inflammatory response. The activity of the calcineurin inhibitor cyclosporin A (FIG. 90A) and Kv1.3 peptide inhibitors ShK-Ala22 (FIG. 90B; SEQ ID No: 123), OSK1-Ala29 (FIG. 90C; SEQ ID No: 1424) and OSK1-Ala12 (FIG. 90D; SEQ ID No: 1410) were compared in the whole blood assay of inflammation (Example 46) using the same donor blood sample. The potency (IC50) of each molecule is shown, where for each panel the left curve is the impact on IL-2 production and the right curve is the impact on IFNγ production.

Figure 91A:
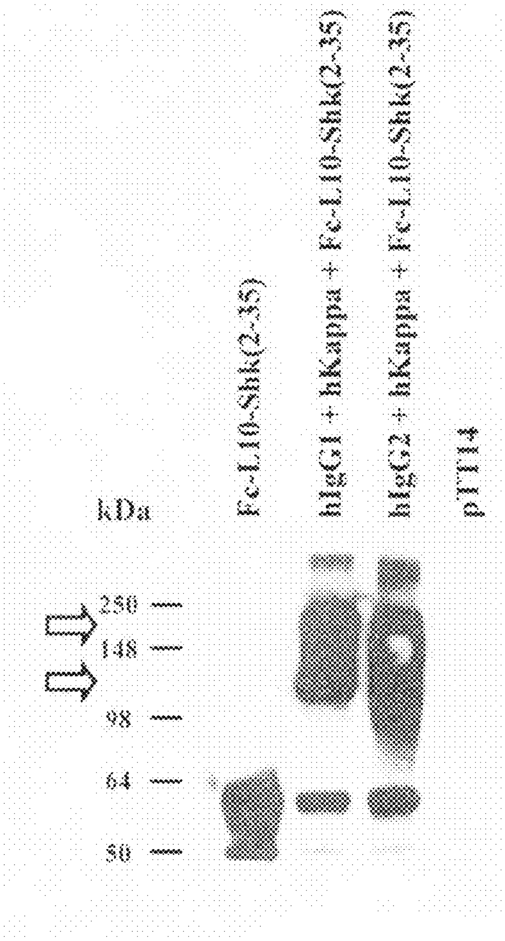
Figure 91B:
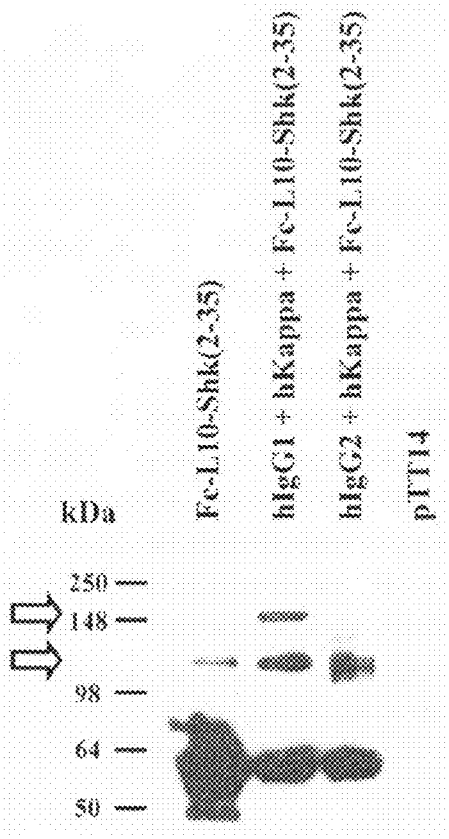

FIG. 91A-B shows an immunoblot analysis of expression of monovalent dimeric IgG1-Fc-L-ShK(2-35) from non-reduced SDS-PAGE. FIG. 91A shows detection of human Fc expression with goat anti-human IgG (H+L)-HRP. FIG. 91B shows detection of ShK(2-35) expression with a goat anti-mouse IgG (H+L)-HRP that cross reacts with human IgG. Lane 1: purified Fc-L10-Shk(2-35); Lane 2: conditioned medium from 293EBNA cells transiently transfected with pTT5-huIgG1+pTT5-hKappa+pCMVi-Fc-L10-ShK(2-35); Lane 3: conditioned media from 293EBNA cells transiently transfected with pTT5-huIgG2+pTT5-hKappa+pCMVi-Fc-L10-Shk(2-35); Lane 4: conditioned media from 293EBNA cells transiently transfected with pTT14 vector alone. The two arrows point to the full length huIgG (mol. wt. ~150 kDa) and monovalent dimeric huIgG-FcShK(2-35) (mol. wt. ~100 kDa); the abundant 60-kDa band is the bivalent dimeric Fc-ShK(2-35).

Figure 92A:
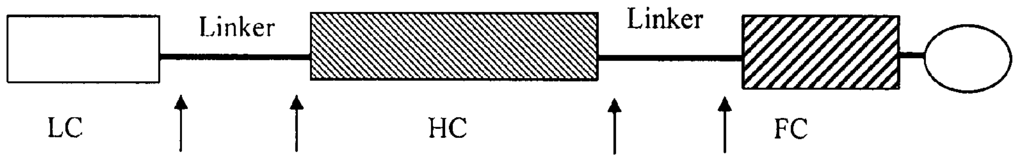
Figure 92B:
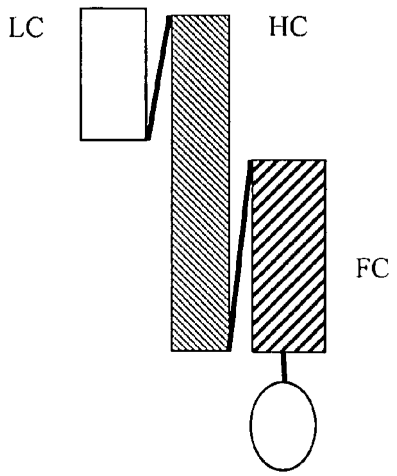
Figure 92C:
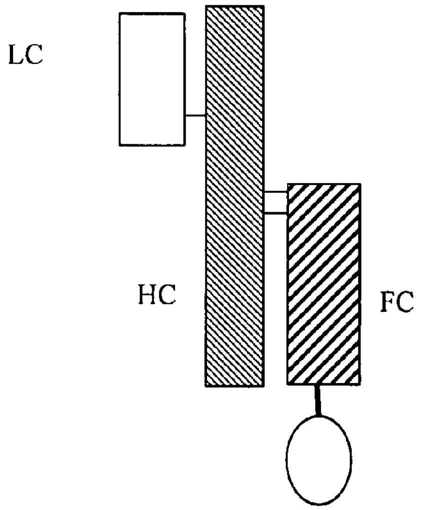

FIG. 92A-C shows schematic representations of an embodiment of a monovalent "hemibody"-toxin peptide fusion protein construct; the single toxin peptide is represented by an oval. FIG. 92A, which can also represent the DNA construct for the fusion protein, represents an immunoglobulin light chain (LC, open rectangle), an immunoglobulin heavy chain (HC, longer cross-hatched rectangle), and an immunoglobulin Fc domain (Fc, shorter cross-hatched rectangle), each separated by an intervening peptidyl linker sequence (thick lines) comprising at least one protease cleavage site (arrows), e.g., a furin cleavage site. FIG. 92 illustrates the association of the recombinantly expressed LC, HC, and Fc-toxin peptide components connected by the peptidyl linker sequences (thick lines) and, in FIG. 92C, the final monovalent chimeric immunoglobulin (LC+HC)-Fc (i.e., "hemibody")-toxin peptide fusion protein after cleavage (intracellularly or extracellularly) at the protease cleavage sites, to release the linkers, and formation of disulfide bridges between the light and heavy chains and between the heavy chain and the Fc components (shown as thin horizontal lines between the LC, HC, and Fc components in FIG. 92C).

DETAILED DESCRIPTION OF EMBODIMENTS OF THE INVENTION

Definition of Terms

The terms used throughout this specification are defined as follows, unless otherwise limited in specific instances. As used in the specification and the appended claims, the singular forms "a", "an", and "the" include plural referents unless the context clearly dictates otherwise.

"Polypeptide" and "protein" are used interchangeably herein and include a molecular chain of two or more amino acids linked through peptide bonds. The terms do not refer to a specific length of the product. Thus, "peptides," and "oligopeptides," are included within the definition of polypeptide. The terms include post-translational modifications of the polypeptide, for example, glycosylations, acetylations, phosphorylations and the like. In addition, protein fragments, analogs, mutated or variant proteins, fusion proteins and the like are included within the meaning of polypeptide. The terms also include molecules in which one or more amino acid analogs or non-canonical or unnatural amino acids are included as can be synthesized, or expressed recombinantly using known protein engineering techniques. In addition, inventive fusion proteins can be derivatized as described herein by well-known organic chemistry techniques.

The term "fusion protein" indicates that the protein includes polypeptide components derived from more than one parental protein or polypeptide. Typically, a fusion protein is expressed from a fusion gene in which a nucleotide sequence encoding a polypeptide sequence from one protein is appended in frame with, and optionally separated by a linker from, a nucleotide sequence encoding a polypeptide sequence from a different protein. The fusion gene can then be expressed by a recombinant host cell as a single protein.

A "domain" of a protein is any portion of the entire protein, up to and including the complete protein, but typically comprising less than the complete protein. A domain can, but need not, fold independently of the rest of the protein chain and/or be correlated with a particular biological, biochemical, or structural function or location (e.g., a ligand binding domain, or a cytosolic, transmembrane or extracellular domain).

A "secreted" protein refers to those proteins capable of being directed to the ER, secretory vesicles, or the extracellular space as a result of a secretory signal peptide sequence, as well as those proteins released into the extracellular space without necessarily containing a signal sequence. If the secreted protein is released into the extracellular space, the secreted protein can undergo extracellular processing to produce a "mature" protein. Release into the extracellular space can occur by many mechanisms, including exocytosis and proteolytic cleavage.

The term "signal peptide" refers to a relatively short (3-60 amino acid residues long) peptide chain that directs the post-translational transport of a protein, e.g., its export to the extracellular space. Thus, secretory signal peptides are encompassed by "signal peptide". Signal peptides may also be called targeting signals, signal sequences, transit peptides, or localization signals.

The term "recombinant" indicates that the material (e.g., a nucleic acid or a polypeptide) has been artificially or synthetically (i.e., non-naturally) altered by human intervention. The alteration can be performed on the material within, or removed from, its natural environment or state. For example, a "recombinant nucleic acid" is one that is made by recombining nucleic acids, e.g., during cloning, DNA shuffling or other well known molecular biological procedures. A "recombinant DNA molecule," is comprised of segments of DNA joined together by means of such molecular biological techniques. The term "recombinant protein" or "recombinant polypeptide" as used herein refers to a protein molecule which is expressed using a recombinant DNA molecule. A "recombinant host cell" is a cell that contains and/or expresses a recombinant nucleic acid.

A "polynucleotide sequence" or "nucleotide sequence" or "nucleic acid sequence," as used interchangeably herein, is a polymer of nucleotides, including an oligonucleotide, a DNA, and RNA, a nucleic acid, or a character string representing a nucleotide polymer, depending on context. From any specified polynucleotide sequence, either the given nucleic acid or the complementary polynucleotide sequence can be determined. Included are DNA or RNA of genomic or synthetic origin which may be single- or double-stranded, and represent the sense or antisense strand.

As used herein, the terms "nucleic acid molecule encoding," "DNA sequence encoding," and "DNA encoding" refer to the order or sequence of deoxyribonucleotides along a strand of deoxyribonucleic acid. The order of these deoxyribonucleotides determines the order of ribonucleotides along the mRNA chain, and also determines the order of amino acids along the polypeptide (protein) chain. The DNA sequence thus codes for the RNA sequence and for the amino acid sequence.

"Expression of a gene" or "expression of a nucleic acid" means transcription of DNA into RNA (optionally including modification of the RNA, e.g., splicing), translation of RNA into a polypeptide (possibly including subsequent post-translational modification of the polypeptide), or both transcription and translation, as indicated by the context.

The term "gene" is used broadly to refer to any nucleic acid associated with a biological function. Genes typically include coding sequences and/or the regulatory sequences required for expression of such coding sequences. The term "gene" applies to a specific genomic or recombinant sequence, as well as to a cDNA or mRNA encoded by that sequence. A "fusion gene" contains a coding region that encodes a fusion protein. Genes also include non-expressed nucleic acid segments that, for example, form recognition sequences for other proteins. Non-expressed regulatory sequences including transcriptional control elements to which regulatory proteins, such as transcription factors, bind, resulting in transcription of adjacent or nearby sequences.

As used herein the term "coding region" when used in reference to a structural gene refers to the nucleotide sequences which encode the amino acids found in the nascent polypeptide as a result of translation of an mRNA molecule. The coding region is bounded, in eukaryotes, on the 5' side by the nucleotide triplet "ATG" which encodes the initiator methionine and on the 3' side by one of the three triplets which specify stop codons (i.e., TAA, TAG, TGA).

Transcriptional control signals in eukaryotes comprise "promoter" and "enhancer" elements. Promoters and enhancers consist of short arrays of DNA sequences that interact specifically with cellular proteins involved in transcription (Maniatis, et al., Science 236:1237 (1987)). Promoter and enhancer elements have been isolated from a variety of eukaryotic sources including genes in yeast, insect and mammalian cells and viruses (analogous control elements, i.e., promoters, are also found in prokaryotes). The selection of a particular promoter and enhancer depends on what cell type is to be used to express the protein of interest. Some eukaryotic promoters and enhancers have a broad host range while others are functional in a limited subset of cell types (for review see Voss, et al., Trends Biochem. Sci., 11:287 (1986) and Maniatis, et al., Science 236:1237 (1987)).

The term "expression vector" as used herein refers to a recombinant DNA molecule containing a desired coding sequence and appropriate nucleic acid sequences necessary for the expression of the operably linked coding sequence in a particular host cell. Nucleic acid sequences necessary for expression in prokaryotes include a promoter, optionally an operator sequence, a ribosome binding site and possibly other sequences. Eukaryotic cells are known to utilize promoters, enhancers, and termination and polyadenylation signals. A secretory signal peptide sequence can also, optionally, be encoded by the expression vector, operably linked to the coding sequence for the inventive recombinant fusion protein, so that the expressed fusion protein can be secreted by the recombinant host cell, for more facile isolation of the fusion protein from the cell, if desired. Such techniques are well known in the art. (E.g., Goodey, Andrew R.; et al., Peptide and DNA sequences, U.S. Pat. No. 5,302,697; Weiner et al., Compositions and methods for protein secretion, U.S. Pat. No. 6,022,952 and U.S. Pat. No. 6,335,178; Uemura et al., Protein expression vector and utilization thereof, U.S. Pat. No. 7,029,909; Ruben et al., 27 human secreted proteins, US 2003/0104400 A1).

The terms "in operable combination", "in operable order" and "operably linked" as used herein refer to the linkage of nucleic acid sequences in such a manner or orientation that a nucleic acid molecule capable of directing the transcription of a given gene and/or the synthesis of a desired protein molecule is produced. The term also refers to the linkage of amino acid sequences in such a manner so that a functional protein is produced and/or transported.

Recombinant DNA- and/or RNA-mediated protein expression techniques, or any other methods of preparing peptides or, are applicable to the making of the inventive recombinant fusion proteins. For example, the peptides can be made in transformed host cells. Briefly, a recombinant DNA molecule, or construct, coding for the peptide is prepared. Methods of preparing such DNA molecules are well known in the art. For instance, sequences encoding the peptides can be excised from DNA using suitable restriction enzymes. Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, biosafety and costs. A balance of these factors must be struck with the understanding that not all hosts may be equally effective for the expression of a particular DNA sequence. Within these general guidelines, useful microbial host cells in culture include bacteria (such as *Escherichia coli* sp.), yeast (such as *Saccharomyces* sp.) and other fungal cells, insect cells, plant cells, mammalian (including human) cells, e.g., CHO cells and HEK293 cells. Modifications can be made at the DNA level, as well. The peptide-encoding DNA sequence may be changed to codons more compatible with the chosen host cell. For *E. coli*, optimized codons are known in the art. Codons can be substituted to eliminate restriction sites or to include silent restriction sites, which may aid in processing of the DNA in the selected host cell. Next, the transformed host is cultured and purified. Host cells may be cultured under conventional fermentation conditions so that the desired compounds are expressed. Such fermentation conditions are well known in the art.

The term "half-life extending moiety" (i.e., $F^1$ or $F^2$ in Formula I) refers to a pharmaceutically acceptable moiety, domain, or "vehicle" covalently linked ("conjugated") to the toxin peptide directly or via a linker, that prevents or mitigates in vivo proteolytic degradation or other activity-diminishing chemical modification of the toxin peptide, increases half-life or other pharmacokinetic properties such as but not limited to increasing the rate of absorption, reduces toxicity, improves solubility, increases biological activity and/or target selectivity of the toxin peptide with respect to a target ion channel of interest, increases manufacturability, and/or reduces immunogenicity of the toxin peptide, compared to an unconjugated form of the toxin peptide.

By "PEGylated peptide" is meant a peptide or protein having a polyethylene glycol (PEG) moiety covalently bound to an amino acid residue of the peptide itself or to a peptidyl or non-peptidyl linker (including but not limited to aromatic or aryl linkers) that is covalently bound to a residue of the peptide.

By "polyethylene glycol" or "PEG" is meant a polyalkylene glycol compound or a derivative thereof, with or without coupling agents or derivatization with coupling or activating moieties (e.g., with aldehyde, hydroxysuccinimidyl, hydrazide, thiol, triflate, tresylate, azirdine, oxirane, orthopyridyl disulphide, vinylsulfone, iodoacetamide or a maleimide moiety). In accordance with the present invention, useful PEG includes substantially linear, straight chain PEG, branched PEG, or dendritic PEG. (See, e.g., Merrill, U.S. Pat. No. 5,171,264; Harris et al., Multiarmed, monofunctional, polymer for coupling to molecules and surfaces, U.S. Pat. No. 5,932,462; Shen, N-maleimidyl polymer derivatives, U.S. Pat. No. 6,602,498).

The term "peptibody" refers to molecules of Formula I in which $F^1$ and/or $F^2$ is an immunoglobulin Fc domain or a portion thereof, such as a CH2 domain of an Fc, or in which the toxin peptide is inserted into a human IgG1 Fc domain loop, such that $F^1$ and $F^2$ are each a portion of an Fc domain with a toxin peptide inserted between them (See, e.g., FIGS. 70-73 and Example 49 herein). Peptibodies of the present invention can also be PEGylated as described further herein, at either an Fc domain or portion thereof, or at the toxin peptide(s) portion of the inventive composition, or both.

The term "native Fc" refers to molecule or sequence comprising the sequence of a non-antigen-binding fragment resulting from digestion of whole antibody, whether in monomeric or multimeric form. The original immunoglobulin source of the native Fc is preferably of human origin and can be any of the immunoglobulins, although IgG1 or IgG2 are preferred. Native Fc's are made up of monomeric polypeptides that can be linked into dimeric or multimeric forms by covalent (i.e., disulfide bonds) and non-covalent association. The number of intermolecular disulfide bonds between monomeric subunits of native Fc molecules ranges from 1 to 4 depending on class (e.g., IgG, IgA, IgE) or subclass (e.g., IgG1, IgG2, IgG3, IgG4, IgA1, IgGA2). One example of a native Fc is a disulfide-bonded dimer resulting from papain digestion of an IgG (see Ellison et al. (1982), *Nucleic Acids Res.* 10: 4071-9). The term "native Fc" as used herein is generic to the monomeric, dimeric, and multimeric forms.

The term "Fc variant" refers to a molecule or sequence that is modified from a native Fc but still comprises a binding site for the salvage receptor, FcRn. Several published patent documents describe exemplary Fc variants, as well as interaction with the salvage receptor. See International Applications WO 97/34 631 (published 25 Sep. 1997; WO 96/32 478, corresponding to U.S. Pat. No. 6,096,891, issued Aug. 1, 2000, hereby incorporated by reference in its entirety; and WO 04/110 472. Thus, the term "Fc variant" includes a molecule or sequence that is humanized from a non-human native Fc. Furthermore, a native Fc comprises sites that can be removed because they provide structural features or biological activity that are not required for the fusion molecules of the present invention. Thus, the term "Fc variant" includes a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fc's, the term "Fc domain" includes molecules in monomeric or multimeric form, whether digested from whole antibody or produced by other means.

The term "multimer" as applied to Fc domains or molecules comprising Fc domains refers to molecules having two or more polypeptide chains associated covalently, noncovalently, or by both covalent and non-covalent interactions. IgG molecules typically form dimers; IgM, pentamers; IgD, dimers; and IgA, monomers, dimers, trimers, or tetramers. One skilled in the art can form multimers by exploiting the sequence and resulting activity of the native Ig source of the Fc or by derivatizing (as defined below) such a native Fc.

Figure 1A:
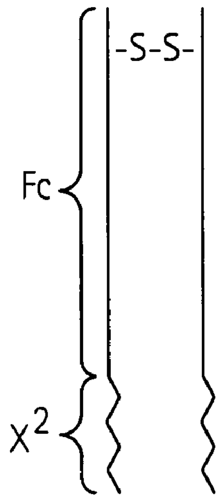
FIG. 1A and FIG. 1D: Single disulfide-bonded dimers.
Figure 1B:
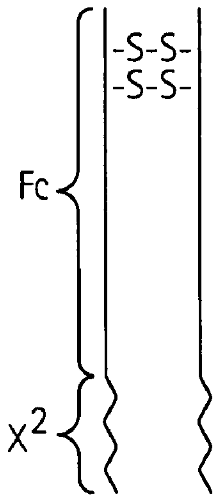
FIG. 1B and FIG. 1E: Doubly disulfide-bonded dimers.
Figure 1C:
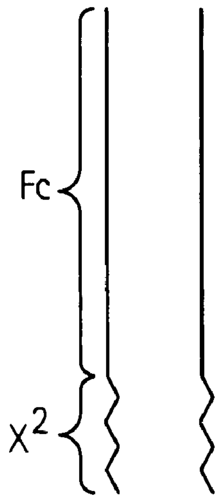
FIG. 1C and FIG. 1F: Noncovalent dimers.
Figure 1D:
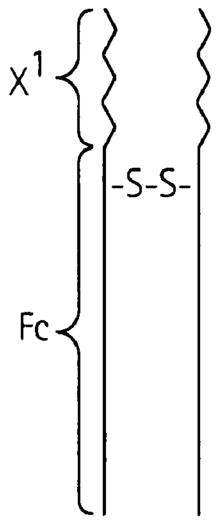
Figure 1E:
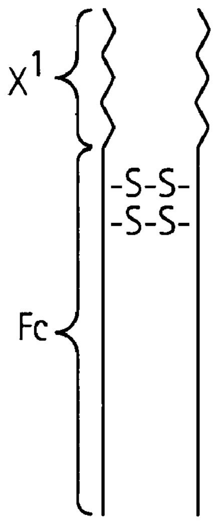
Figure 1F:
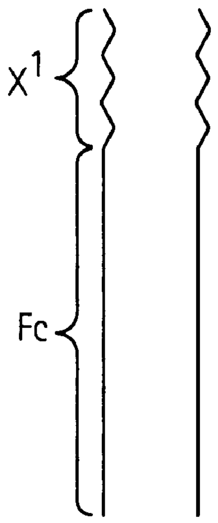
Figure 2A:
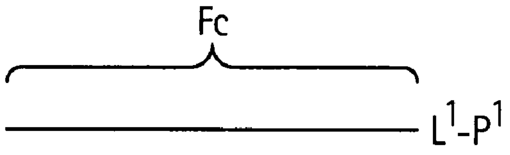
FIG. 2A-C show schematic structures of some embodiments of the composition of the invention that shows a single unit of the pharmacologically active toxin peptide.
Figure 2B:
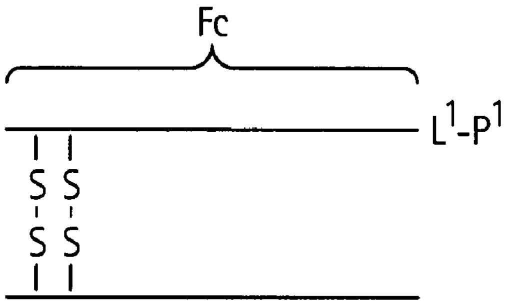
Figure 2C:
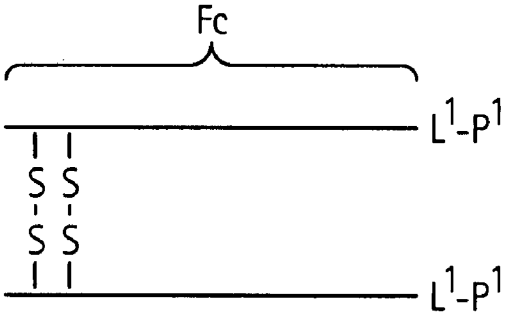

The term "dimer" as applied to Fc domains or molecules comprising Fc domains refers to molecules having two polypeptide chains associated covalently or non-covalently. Thus, exemplary dimers within the scope of this invention are as shown in FIG. 2. A "monovalent dimeric" Fc-toxin peptide fusion, or "monovalent dimer", is a Fc-toxin peptide fusion that includes a toxin peptide conjugated with only one of the dimerized Fc domains (e.g., as represented schematically in FIG. 2B). A "bivalent dimeric" Fc-toxin peptide fusion, or "bivalent dimer", is a Fc-toxin peptide fusion having both of the dimerized Fc domains each conjugated separately with a toxin peptide (e.g., as represented schematically in FIG. 2C).

The terms "derivatizing" and "derivative" or "derivatized" comprise processes and resulting compounds respectively in which (1) the compound has a cyclic portion; for example, cross-linking between cysteinyl residues within the compound; (2) the compound is cross-linked or has a cross-linking site; for example, the compound has a cysteinyl residue and thus forms cross-linked dimers in culture or in vivo; (3) one or more peptidyl linkage is replaced by a non-peptidyl linkage; (4) the N-terminus is replaced by —NRR$^1$, NRC(O)R$^1$, —NRC(O)OR$^1$, —NRS(O)$_2$R$^1$, —NHC(O)NHR, a succinimide group, or substituted or unsubstituted benzyloxycarbonyl-NH—, wherein R and R$^1$ and the ring substituents are as defined hereinafter; (5) the C-terminus is replaced by —C(O)R$^2$ or —NR$^3$R$^4$ wherein R$^2$, R$^3$ and R$^4$ are as defined hereinafter; and (6) compounds in which individual amino acid moieties are modified through treatment with agents capable of reacting with selected side chains or terminal residues. Derivatives are further described hereinafter.

The term "peptide" refers to molecules of 2 to about 80 amino acid residues, with molecules of about 10 to about 60 amino acid residues preferred and those of about 30 to about 50 amino acid residues most preferred. Exemplary peptides can be randomly generated by any known method, carried in a peptide library (e.g., a phage display library), or derived by digestion of proteins. In any peptide portion of the inventive compositions, for example a toxin peptide or a peptide linker moiety described herein, additional amino acids can be included on either or both of the N- or C-termini of the given sequence. Of course, these additional amino acid residues should not significantly interfere with the functional activity of the composition.

"Toxin peptides" include peptides having the same amino acid sequence of a naturally occurring pharmacologically active peptide that can be isolated from a venom, and also include modified peptide analogs (spelling used interchangeably with "analogues") of such naturally occurring molecules.

The term "peptide analog" refers to a peptide having a sequence that differs from a peptide sequence existing in nature by at least one amino acid residue substitution, internal addition, or internal deletion of at least one amino acid, and/or amino- or carboxy-terminal end truncations, or additions). An "internal deletion" refers to absence of an amino acid from a sequence existing in nature at a position other than the N- or C-terminus. Likewise, an "internal addition" refers to presence of an amino acid in a sequence existing in nature at a position other than the N- or C-terminus. "Toxin peptide analogs", such as, but not limited to, an OSK1 peptide analog, ShK peptide analog, or ChTx peptide analog, contain modifications of a native toxin peptide sequence of interest (e.g., amino acid residue substitutions, internal additions or insertions, internal deletions, and/or amino- or carboxy-terminal end truncations, or additions as previously described above) relative to a native toxin peptide sequence of interest, which is in the case of OSK1: GVIINVKCKISRQCLEPCKKAGMRFGKCMNGKCHCTPK (SEQ ID NO:25).

Examples of toxin peptides useful in practicing the present invention are listed in Tables 1-32. The toxin peptide ("P", or equivalently shown as "P$^1$" in FIG. 2) comprises at least two intrapeptide disulfide bonds, as shown, for example, in FIG. 9. Accordingly, this invention concerns molecules comprising:

a) C$^1$-C$^3$ and C$^2$-C$^4$ disulfide bonding in which C$^1$, C$^2$, C$^3$, and C$^4$ represent the order in which cysteine residues appear in the primary sequence of the toxin peptide stated conventionally with the N-terminus of the peptide on the left, with the first and third cysteines in the amino acid sequence forming a disulfide bond, and the second and fourth cysteines forming a disulfide bond. Examples of toxin peptides with such a C$^1$-C$^3$, C$^2$-C$^4$ disulfide bonding pattern include, but are not limited to, apamin peptides, α-conopeptides, PnIA peptides, PnIB peptides, and MII peptides, and analogs of any of the foregoing.

b) C$^1$-C$^6$, C$^2$-C$^4$ and C$^3$-C$^5$ disulfide bonding in which, as described above, C$^1$, C$^2$, C$^3$, C$^4$, C$^5$ and C$^6$ represent the order of cysteine residues appearing in the primary sequence of the toxin peptide stated conventionally with the N-terminus of the peptide(s) on the left, with the first and sixth cysteines in the amino acid sequence forming a disulfide bond, the second and fourth cysteines forming a disulfide bond, and the third and fifth cysteines forming a disulfide bond. Examples of toxin peptides with such a $C^1$-$C^6$, $C^2$-$C^4$, $C^3$-$C^5$ disulfide bonding pattern include, but are not limited to, ShK, BgK, HmK, AeKS, AsK, and DTX1, and analogs of any of the foregoing.

c) $C^1$-$C^4$, $C^2$-$C^5$ and $C^3$-$C^6$ disulfide bonding in which, as described above, $C^1$, $C^2$, $C^3$, $C^4$, $C^5$ and $C^6$ represent the order of cysteine residues appearing in the primary sequence of the toxin peptide stated conventionally with the N-terminus of the peptide(s) on the left, with the first and fourth cysteines in the amino acid sequence forming a disulfide bond, the second and fifth cysteines forming a disulfide bond, and the third and sixth cysteines forming a disulfide bond. Examples of toxin peptides with such a $C^1$-$C^4$, $C^2$-$C^5$, $C^3$-$C^6$ disulfide bonding pattern include, but are not limited to, ChTx, MgTx, OSK1, KTX1, AgTx2, Pi2, Pi3, NTX, HgTx1, BeKM1, BmKTX, P01, BmKK6, Tc32, Tc1, BmTx1, BmTX3, IbTx, P05, ScyTx, TsK, HaTx1, ProTX1, PaTX2, Ptu1, ωGVIA, ωMVIIA, and SmIIIa, and analogs of any of the foregoing.

d) $C^1$-$C^5$, $C^2$-$C^6$, $C^3$-$C^7$, and $C^4$-$C^8$ disulfide bonding in which $C^1$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fifth cysteines in the amino acid sequence forming a disulfide bond, the second and sixth cysteines forming a disulfide bond, the third and seventh cysteines forming a disulfide bond, and the fourth and eighth cysteines forming a disulfide bond. Examples of toxin peptides with such a $C^1$-$C^5$, $C^2$-$C^6$, $C^3$-$C^7$, $C^4$-$C^8$ disulfide bonding pattern include, but are not limited to, Anuoroctoxin (AnTx), Pi1, HsTx1, MTX (P12A, P20A), and Pi4 peptides, and analogs of any of the foregoing.

e) $C^1$-$C^4$, $C^2$-$C^6$, $C^3$-$C^7$, and $C^5$-$C^8$ disulfide bonding in which $C^7$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fourth cysteines in the amino acid sequence forming a disulfide bond, the second and sixth cysteines forming a disulfide bond, the third and seventh cysteines forming a disulfide bond, and the fifth and eighth cysteines forming a disulfide bond. Examples of toxin peptides with such a $C^1$-$C^4$, $C^2$-$C^6$, $C^3$-$C^7$, $C^5$-$C^8$ disulfide bonding pattern include, but are not limited to, Chlorotoxin, Bm-12b, and, and analogs of either.

f) $C^1$-$C^5$, $C^2$-$C^6$, $C^3$-$C^4$, and $C^7$-$C^8$ disulfide bonding in which $C^1$, $C^2$, $C^3$, $C^4$, $C^5$, $C^6$, $C^7$ and $C^8$ represent the order of cysteine residues appearing in the primary sequence of the toxin peptide stated conventionally with the N-terminus of the peptide(s) on the left, with the first and fifth cysteines in the amino acid sequence forming a disulfide bond, the second and sixth cysteines forming a disulfide bond, the third and fourth cysteines forming a disulfide bond, and the seventh and eighth cysteines forming a disulfide bond. Examples of toxin peptides with such a $C^1$-$C^5$, $C^2$-$C^6$, $C^3$-$C^4$, $C^7$-$C^8$ disulfide bonding pattern include, but are not limited to, Maurotoxin peptides and analogs thereof.

The term "randomized" as used to refer to peptide sequences refers to fully random sequences (e.g., selected by phage display methods) and sequences in which one or more residues of a naturally occurring molecule is replaced by an amino acid residue not appearing in that position in the naturally occurring molecule. Exemplary methods for identifying peptide sequences include phage display, *E. coli* display, ribosome display, yeast-based screening, RNA-peptide screening, chemical screening, rational design, protein structural analysis, and the like.

The term "pharmacologically active" means that a substance so described is determined to have activity that affects a medical parameter (e.g., blood pressure, blood cell count, cholesterol level) or disease state (e.g., cancer, autoimmune disorders). Thus, pharmacologically active peptides comprise agonistic or mimetic and antagonistic peptides as defined below.

The terms "-mimetic peptide" and "-agonist peptide" refer to a peptide having biological activity comparable to a naturally occurring toxin peptide molecule, e.g., naturally occurring ShK toxin peptide. These terms further include peptides that indirectly mimic the activity of a naturally occurring toxin peptide molecule, such as by potentiating the effects of the naturally occurring molecule.

The term "antagonist peptide" or "inhibitor peptide" refers to a peptide that blocks or in some way interferes with the biological activity of a receptor of interest, or has biological activity comparable to a known antagonist or inhibitor of a receptor of interest (such as, but not limited to, an ion channel).

The term "acidic residue" refers to amino acid residues in D- or L-form having sidechains comprising acidic groups. Exemplary acidic residues include D and E.

The term "amide residue" refers to amino acids in D- or L-form having sidechains comprising amide derivatives of acidic groups. Exemplary residues include N and Q.

The term "aromatic residue" refers to amino acid residues in D- or L-form having sidechains comprising aromatic groups. Exemplary aromatic residues include F, Y, and W.

The term "basic residue" refers to amino acid residues in D- or L-form having sidechains comprising basic groups. Exemplary basic residues include H, K, R, N-methyl-arginine, ω-aminoarginine, ω-methyl-arginine, 1-methyl-histidine, 3-methyl-histidine, and homoarginine (hR) residues.

The term "hydrophilic residue" refers to amino acid residues in D- or L-form having sidechains comprising polar groups. Exemplary hydrophilic residues include C, S, T, N, Q, D, E, K, and citrulline (Cit) residues.

The term "nonfunctional residue" refers to amino acid residues in D- or L-form having sidechains that lack acidic, basic, or aromatic groups. Exemplary nonfunctional amino acid residues include M, G, A, V, I, L and norleucine (Nle).

The term "neutral polar residue" refers to amino acid residues in D- or L-form having sidechains that lack basic, acidic, or polar groups. Exemplary neutral polar amino acid residues include A, V, L, I, P, W, M, and F.

The term "polar hydrophobic residue" refers to amino acid residues in D- or L-form having sidechains comprising polar groups. Exemplary polar hydrophobic amino acid residues include T, G, S, Y, C, Q, and N.

The term "hydrophobic residue" refers to amino acid residues in D- or L-form having sidechains that lack basic or acidic groups. Exemplary hydrophobic amino acid residues include A, V, L, I, P, W, M, F, T, G, S, Y, C, Q, and N.

In some useful embodiments of the compositions of the invention, the amino acid sequence of the toxin peptide is modified in one or more ways relative to a native toxin peptide sequence of interest, such as, but not limited to, a native ShK or OSK1 sequence, their peptide analogs, or any other toxin peptides having amino acid sequences as set for in any of Tables 1-32. The one or more useful modifications can include amino acid additions or insertions, amino acid deletions, peptide truncations, amino acid substitutions, and/or chemical derivatization of amino acid residues, accomplished by known chemical techniques. Such modifications can be, for example, for the purpose of enhanced potency, selectivity, and/or proteolytic stability, or the like. Those skilled in the art are aware of techniques for designing peptide analogs with such enhanced properties, such as alanine scanning, rational design based on alignment mediated mutagenesis using known toxin peptide sequences and/or molecular modeling. For example, ShK analogs can be designed to remove protease cleavage sites (e.g., trypsin cleavage sites at K or R residues and/or chymotrypsin cleavage sites at F, Y, or W residues) in a ShK peptide- or ShK analog-containing composition of the invention, based partially on alignment mediated mutagenesis using HmK (see, e.g., FIG. 6) and molecular modeling. (See, e.g., Kalman et al., ShK-Dap22, a potent Kv1.3-specific immunosuppressive polypeptide, J. Biol. Chem. 273(49):32697-707 (1998); Kem et al., U.S. Pat. No. 6,077,680; Mouhat et al., OsK1 derivatives, WO 2006/002850 A2)).

The term "protease" is synonymous with "peptidase". Proteases comprise two groups of enzymes: the endopeptidases which cleave peptide bonds at points within the protein, and the exopeptidases, which remove one or more amino acids from either N- or C-terminus respectively. The term "proteinase" is also used as a synonym for endopeptidase. The four mechanistic classes of proteinases are: serine proteinases, cysteine proteinases, aspartic proteinases, and metallo-proteinases. In addition to these four mechanistic classes, there is a section of the enzyme nomenclature which is allocated for proteases of unidentified catalytic mechanism. This indicates that the catalytic mechanism has not been identified.

Cleavage subsite nomenclature is commonly adopted from a scheme created by Schechter and Berger (Schechter I. & Berger A., On the size of the active site in proteases. I. Papain, Biochemical and Biophysical Research Communication, 27:157 (1967); Schechter I. & Berger A., On the active site of proteases. 3. Mapping the active site of papain; specific inhibitor peptides of papain, Biochemical and Biophysical Research Communication, 32:898 (1968)). According to this model, amino acid residues in a substrate undergoing cleavage are designated P1, P2, P3, P4 etc. in the N-terminal direction from the cleaved bond. Likewise, the residues in the C-terminal direction are designated P1', P2', P3', P4'. etc.

The skilled artisan is aware of a variety of tools for identifying protease binding or protease cleavage sites of interest. For example, the PeptideCutter software tool is available through the ExPASy (Expert Protein Analysis System) proteomics server of the Swiss Institute of Bioinformatics (SIB; expasy.org/tools/peptidecutter). PeptideCutter searches a protein sequence from the SWISS-PROT and/or TrEMBL databases or a user-entered protein sequence for protease cleavage sites. Single proteases and chemicals, a selection or the whole list of proteases and chemicals can be used. Different forms of output of the results are available: tables of cleavage sites either grouped alphabetically according to enzyme names or sequentially according to the amino acid number. A third option for output is a map of cleavage sites. The sequence and the cleavage sites mapped onto it are grouped in blocks, the size of which can be chosen by the user. Other tools are also known for determining protease cleavage sites. (E.g., Turk, B. et al., Determination of protease cleavage site motifs using mixture-based oriented peptide libraries, Nature Biotechnology, 19:661-667 (2001); Barrett A. et al., Handbook of proteolytic enzymes, Academic Press (1998)).

The serine proteinases include the chymotrypsin family, which includes mammalian protease enzymes such as chymotrypsin, trypsin or elastase or kallikrein. The serine proteinases exhibit different substrate specificities, which are related to amino acid substitutions in the various enzyme subsites interacting with the substrate residues. Some enzymes have an extended interaction site with the substrate whereas others have a specificity restricted to the P1 substrate residue.

Trypsin preferentially cleaves at R or K in position P1. A statistical study carried out by Keil (1992) described the negative influences of residues surrounding the Arg- and Lys-bonds (i.e. the positions P2 and P1', respectively) during trypsin cleavage. (Keil, B., Specificity of proteolysis, Springer-Verlag Berlin-Heidelberg-New York, 335 (1992)). A proline residue in position P1' normally exerts a strong negative influence on trypsin cleavage. Similarly, the positioning of R and K in P1' results in an inhibition, as well as negatively charged residues in positions P2 and P1'.

Chymotrypsin preferentially cleaves at a W, Y or F in position P1 (high specificity) and to a lesser extent at L, M or H residue in position P1. (Keil, 1992). Exceptions to these rules are the following: When W is found in position P1, the cleavage is blocked when M or P are found in position P1' at the same time. Furthermore, a proline residue in position P1' nearly fully blocks the cleavage independent of the amino acids found in position P1. When an M residue is found in position P1, the cleavage is blocked by the presence of a Y residue in position P1'. Finally, when H is located in position P1, the presence of a D, M or W residue also blocks the cleavage.

Membrane metallo-endopeptidase (NEP; neutral endopeptidase, kidney-brush-border neutral proteinase, enkephalinase, EC 3.4.24.11) cleaves peptides at the amino side of hydrophobic amino acid residues. (Connelly, J C et al., Neutral Endopeptidase 24.11 in Human Neutrophils: Cleavage of Chemotactic Peptide, PNAS, 82(24):8737-8741 (1985)).

Thrombin preferentially cleaves at an R residue in position P1. (Keil, 1992). The natural substrate of thrombin is fibrinogen. Optimum cleavage sites are when an R residue is in position P1 and Gly is in position P2 and position P1'. Likewise, when hydrophobic amino acid residues are found in position P4 and position P3, a proline residue in position P2, an R residue in position P1, and non-acidic amino acid residues in position P1' and position P2'. A very important residue for its natural substrate fibrinogen is a D residue in P10.

Caspases are a family of cysteine proteases bearing an active site with a conserved amino acid sequence and which cleave peptides specifically following D residues. (Eamshaw W C et al., Mammalian caspases: Structure, activation, substrates, and functions during apoptosis, Annual Review of Biochemistry, 68:383-424 (1999)).

The Arg-C proteinase preferentially cleaves at an R residue in position P1. The cleavage behavior seems to be only moderately affected by residues in position P1'. (Keil, 1992). The Asp-N endopeptidase cleaves specifically bonds with a D residue in position P1'. (Keil, 1992).

Furin is a ubiquitous subtilisin-like proprotein convertase. It is the major processing enzyme of the secretory pathway and intracellularly is localized in the trans-golgi network (van den Ouweland, A. M. W. et al. (1990) Nucl. Acids Res., 18, 664; Steiner, D. F. (1998) Curr. Opin. Chem. Biol., 2, 31-39). The minimal furin cleavage site is Arg-X-X-Arg'. However, the enzyme prefers the site Arg-X-(Lys/Arg)-Arg'. An additional arginine at the P6 position appears to enhance cleavage (Krysan, D. J. et al. (1999) J. Biol. Chem., 274, 23229-23234).

The foregoing is merely exemplary and by no means an exhaustive treatment of knowledge available to the skilled artisan concerning protease binding and/or cleavage sites that the skilled artisan may be interested in eliminating in practicing the invention.

Additional useful embodiments of the toxin peptide, e.g., the OSK1 peptide analog, can result from conservative modifications of the amino acid sequences of the peptides disclosed herein. Conservative modifications will produce peptides having functional, physical, and chemical characteristics similar to those of the parent peptide from which such modifications are made. Such conservatively modified forms of the peptides disclosed herein are also contemplated as being an embodiment of the present invention.

In contrast, substantial modifications in the functional and/or chemical characteristics of the toxin peptides may be accomplished by selecting substitutions in the amino acid sequence that differ significantly in their effect on maintaining (a) the structure of the molecular backbone in the region of the substitution, for example, as an α-helical conformation, (b) the charge or hydrophobicity of the molecule at the target site, or (c) the size of the molecule.

For example, a "conservative amino acid substitution" may involve a substitution of a native amino acid residue with a normative residue such that there is little or no effect on the polarity or charge of the amino acid residue at that position. Furthermore, any native residue in the polypeptide may also be substituted with alanine, as has been previously described for "alanine scanning mutagenesis" (see, for example, MacLennan et al., Acta Physiol. Scand. Suppl., 643:55-67 (1998); Sasaki et al., 1998, Adv. Biophys. 35:1-24 (1998), which discuss alanine scanning mutagenesis).

Desired amino acid substitutions (whether conservative or non-conservative) can be determined by those skilled in the art at the time such substitutions are desired. For example, amino acid substitutions can be used to identify important residues of the peptide sequence, or to increase or decrease the affinity of the peptide or vehicle-conjugated peptide molecules described herein.

Naturally occurring residues may be divided into classes based on common side chain properties:

1) hydrophobic: norleucine (Nor), Met, Ala, Val, Leu, lie;
2) neutral hydrophilic: Cys, Ser, Thr, Asn, Gln;
3) acidic: Asp, Glu;
4) basic: His, Lys, Arg;
5) residues that influence chain orientation: Gly, Pro; and
6) aromatic: Trp, Tyr, Phe.

Conservative amino acid substitutions may involve exchange of a member of one of these classes with another member of the same class. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties.

Non-conservative substitutions may involve the exchange of a member of one of these classes for a member from another class. Such substituted residues may be introduced into regions of the human antibody that are homologous with non-human antibodies, or into the non-homologous regions of the molecule.

In making such changes, according to certain embodiments, the hydropathic index of amino acids may be considered. Each amino acid has been assigned a hydropathic index on the basis of its hydrophobicity and charge characteristics. They are: isoleucine (+4.5); valine (+4.2); leucine (+3.8); phenylalanine (+2.8); cysteine/cystine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

The importance of the hydropathic amino acid index in conferring interactive biological function on a protein is understood in the art (see, for example, Kyte et al., 1982, *J. Mol. Biol.* 157:105-131). It is known that certain amino acids may be substituted for other amino acids having a similar hydropathic index or score and still retain a similar biological activity. In making changes based upon the hydropathic index, in certain embodiments, the substitution of amino acids whose hydropathic indices are within ±2 is included. In certain embodiments, those that are within ±1 are included, and in certain embodiments, those within ±0.5 are included.

It is also understood in the art that the substitution of like amino acids can be made effectively on the basis of hydrophilicity, particularly where the biologically functional protein or peptide thereby created is intended for use in immunological embodiments, as disclosed herein. In certain embodiments, the greatest local average hydrophilicity of a protein, as governed by the hydrophilicity of its adjacent amino acids, correlates with its immunogenicity and antigenicity, i.e., with a biological property of the protein.

The following hydrophilicity values have been assigned to these amino acid residues: arginine (+3.0); lysine (+3.0); aspartate (+3.0±1); glutamate (+3.0±1); serine (+0.3); asparagine (+0.2); glutamine (+0.2); glycine (0); threonine (−0.4); proline (−0.5±1); alanine (−0.5); histidine (−0.5); cysteine (−1.0); methionine (−1.3); valine (−1.5); leucine (−1.8); isoleucine (−1.8); tyrosine (−2.3); phenylalanine (−2.5) and tryptophan (−3.4). In making changes based upon similar hydrophilicity values, in certain embodiments, the substitution of amino acids whose hydrophilicity values are within ±2 is included, in certain embodiments, those that are within ±1 are included, and in certain embodiments, those within ±0.5 are included. One may also identify epitopes from primary amino acid sequences on the basis of hydrophilicity. These regions are also referred to as "epitopic core regions."

Examples of conservative substitutions include the substitution of one non-polar (hydrophobic) amino acid residue such as isoleucine, valine, leucine norleucine, alanine, or methionine for another, the substitution of one polar (hydrophilic) amino acid residue for another such as between arginine and lysine, between glutamine and asparagine, between glycine and serine, the substitution of one basic amino acid residue such as lysine, arginine or histidine for another, or the substitution of one acidic residue, such as aspartic acid or glutamic acid for another. The phrase "conservative amino acid substitution" also includes the use of a chemically derivatized residue in place of a non-derivatized residue, provided that such polypeptide displays the requisite biological activity. Other exemplary amino acid substitutions that can be useful in accordance with the present invention are set forth in Table 1A.

TABLE 1A

Some Useful Amino Acid Substitutions

| Original Residues | Exemplary Substitutions |
|---|---|
| Ala | Val, Leu, Ile |
| Arg | Lys, Gln, Asn |
| Asn | Gln |
| Asp | Glu |
| Cys | Ser, Ala |

TABLE 1A-continued

| Some Useful Amino Acid Substitutions | |
|---|---|
| Original Residues | Exemplary Substitutions |
| Gln | Asn |
| Glu | Asp |
| Gly | Pro, Ala |
| His | Asn, Gln, Lys, Arg |
| Ile | Leu, Val, Met, Ala, Phe, Norleucine |
| Leu | Norleucine, Ile, Val, Met, Ala, Phe |
| Lys | Arg, 1,4-Diamino-butyric Acid, Gln, Asn |
| Met | Leu, Phe, Ile |
| Phe | Leu, Val, Ile, Ala, Tyr |
| Pro | Ala |
| Ser | Thr, Ala, Cys |
| Thr | Ser |
| Trp | Tyr, Phe |
| Tyr | Trp, Phe, Thr, Ser |
| Val | Ile, Met, Leu, Phe, Ala, Norleucine |

In other examples, a toxin peptide amino acid sequence, e.g., an OSK1 peptide analog sequence, modified from a naturally occurring toxin peptide amino acid sequence includes at least one amino acid residue inserted or substituted therein, relative to the amino acid sequence of the native toxin peptide sequence of interest, in which the inserted or substituted amino acid residue has a side chain comprising a nucleophilic or electrophilic reactive functional group by which the peptide is conjugated to a linker or half-life extending moiety. In accordance with the invention, useful examples of such a nucleophilic or electrophilic reactive functional group include, but are not limited to, a thiol, a primary amine, a seleno, a hydrazide, an aldehyde, a carboxylic acid, a ketone, an aminooxy, a masked (protected) aldehyde, or a masked (protected) keto functional group. Examples of amino acid residues having a side chain comprising a nucleophilic reactive functional group include, but are not limited to, a lysine residue, an α,β-diaminopropionic acid residue, an α,γ-diaminobutyric acid residue, an ornithine residue, a cysteine, a homocysteine, a glutamic acid residue, an aspartic acid residue, or a selenocysteine residue. In some embodiments, the toxin peptide amino acid sequence (or "primary sequence") is modified at one, two, three, four, five or more amino acid residue positions, by having a residue substituted therein different from the native primary sequence (e.g., OSK1 SEQ ID NO:25) or omitted (e.g., an OSK1 peptide analog optionally lacking a residue at positions 36, 37, 36-38, 37-38, or 38).

In further describing toxin peptides herein, a one-letter abbreviation system is frequently applied to designate the identities of the twenty "canonical" amino acid residues generally incorporated into naturally occurring peptides and proteins (Table 1B). Such one-letter abbreviations are entirely interchangeable in meaning with three-letter abbreviations, or non-abbreviated amino acid names. Within the one-letter abbreviation system used herein, an uppercase letter indicates a L-amino acid, and a lower case letter indicates a D-amino acid, unless otherwise noted herein. For example, the abbreviation "R" designates L-arginine and the abbreviation "r" designates D-arginine.

TABLE 1B

| One-letter abbreviations for the canonical amino acids Three-letter abbreviations are in parentheses | |
|---|---|
| Alanine (Ala) | A |
| Glutamine (Gln) | Q |
| Leucine (Leu) | L |
| Serine (Ser) | S |
| Arginine (Arg) | R |
| Glutamic Acid (Glu) | E |
| Lysine (Lys) | K |
| Threonine (Thr) | T |
| Asparagine (Asn) | N |
| Glycine (Gly) | G |
| Methionine (Met) | M |
| Tryptophan (Trp) | W |
| Aspartic Acid (Asp) | D |
| Histidine (His) | H |
| Phenylalanine (Phe) | F |
| Tyrosine (Tyr) | Y |
| Cysteine (Cys) | C |
| Isoleucine (Ile) | I |
| Proline (Pro) | P |
| Valine (Val) | V |

An amino acid substitution in an amino acid sequence is typically designated herein with a one-letter abbreviation for the amino acid residue in a particular position, followed by the numerical amino acid position relative to the native toxin peptide sequence of interest, which is then followed by the one-letter symbol for the amino acid residue substituted in. For example, "T30D" symbolizes a substitution of a threonine residue by an aspartate residue at amino acid position 30, relative to a hypothetical native toxin peptide sequence. By way of further example, "R18hR" or "R18Cit" indicates a substitution of an arginine residue by a homoarginine or a citrulline residue, respectively, at amino acid position 18, relative to the hypothetical native toxin peptide. An amino acid position within the amino acid sequence of any particular toxin peptide (or peptide analog) described herein may differ from its position relative to the native sequence, i.e., as determined in an alignment of the N-terminal or C-terminal end of the peptide's amino acid sequence with the N-terminal or C-terminal end, as appropriate, of the native toxin peptide sequence. For example, amino acid position 1 of the sequence SCIDTIPKSRCTAFQCKHSMKYRLSFCRKTCGTC ShK (2-35); SEQ ID NO:92), a N-terminal truncation of the native ShK sequence, thus aligned with the C-terminal of native ShK(1-35) (SEQ ID NO:5), corresponds to amino acid position 2 relative to the native sequence, and amino acid position 34 of SEQ ID NO:92 corresponds to amino acid position 35 relative to the native sequence (SEQ ID NO:5).

In certain embodiments of the present invention, amino acid substitutions encompass, non-canonical amino acid residues, which include naturally rare (in peptides or proteins) amino acid residues or unnatural amino acid residues. Non-canonical amino acid residues can be incorporated into the peptide by chemical peptide synthesis rather than by synthesis in biological systems, such as recombinantly expressing cells, or alternatively the skilled artisan can employ known techniques of protein engineering that use recombinantly expressing cells. (See, e.g., Link et al., Non-canonical amino acids in protein engineering, Current Opinion in Biotechnology, 14(6):603-609 (2003)). The term "non-canonical amino acid residue" refers to amino acid residues in D- or L-form that are not among the 20 canonical amino acids generally incorporated into naturally occurring proteins, for example, β-amino acids, homoamino acids, cyclic amino acids and amino acids with derivatized side chains. Examples include (in the L-form or D-form; abbreviated as in parentheses): citrulline (Cit), homocitrulline (hCit), $N^{\alpha}$-methylcitrulline (NMeCit), $N^{\alpha}$-methylhomocitrulline ($N^{\alpha}$-MeHoCit), ornithine (Orn), $N^{\alpha}$-Methylornithine ($N^{\alpha}$-MeOrn or NMeOrn), sarcosine (Sar), homolysine (hLys or hK), homoarginine (hArg or hR), homoglutamine (hQ), $N^{\alpha}$-methylarginine (NMeR), $N^{\alpha}$-methylleucine ($N^{\alpha}$-MeL or NMeL), N-methylhomolysine (NMeHoK), $N^{\alpha}$-methylglutamine (NMeQ), norleucine (Nle), norvaline (Nva), 1,2,3,4-tetrahydroisoquinoline (Tic), Octahydroindole-2-carboxylic acid (Oic), 3-(1-naphthyl)alanine (1-Nal), 3-(2-naphthyl)alanine (2-Nal), 1,2,3,4-tetrahydroisoquinoline (Tic), 2-indanylglycine (Igl), para-iodophenylalanine (pI-Phe), para-aminophenylalanine (4AmP or 4-Amino-Phe), 4-guanidino phenylalanine (Guf), glycyllysine (abbreviated herein "K($N^{\epsilon}$-glycyl)" or "K(glycyl)" or "K(gly)"), nitrophenylalanine (nitrophe), aminophenylalanine (aminophe or Amino-Phe), benzylphenylalanine (benzylphe), γ-carboxyglutamic acid (γ-carboxyglu), hydroxyproline (hydroxypro), p-carboxyl-phenylalanine (Cpa), α-aminoadipic acid (Aad), Nα-methyl valine (NMe-Val), N-α-methyl leucine (NMeLeu), Nα-methylnorleucine (NMeNle), cyclopentylglycine (Cpg), cyclohexylglycine (Chg), acetylarginine (acetylarg), α,β-diaminopropionoic acid (Dpr), α,γ-diaminobutyric acid (Dab), diaminopropionic acid (Dap), cyclohexylalanine (Cha), 4-methyl-phenylalanine (MePhe), β,β-diphenyl-alanine (BiPhA), aminobutyric acid (Abu), 4-phenyl-phenylalanine (or biphenylalanine; 4Bip), α-amino-isobutyric acid (Aib), beta-alanine, beta-aminopropionic acid, piperidinic acid, aminocaproic acid, aminoheptanoic acid, aminopimelic acid, desmosine, diaminopimelic acid, N-ethylglycine, N-ethylaspargine, hydroxylysine, allo-hydroxylysine, isodesmosine, allo-isoleucine, N-methylglycine, N-methylisoleucine, N-methylvaline, 4-hydroxyproline (Hyp), γ-carboxyglutamate, ε-N,N,N-trimethyllysine, ε-N-acetyllysine, O-phosphoserine, N-acetylserine, N-formylmethionine, 3-methylhistidine, 5-hydroxylysine, ω-methylarginine, 4-Amino-O-Phthalic Acid (4APA), and other similar amino acids, and derivatized forms of any of these as described herein. Table 1B contains some exemplary non-canonical amino acid residues that are useful in accordance with the present invention and associated abbreviations as typically used herein, although the skilled practitioner will understand that different abbreviations and nomenclatures may be applicable to the same substance and my appear interchangeably herein.

Table 1B. Useful non-canonical amino acids for amino acid addition, insertion, or substitution into toxin peptide sequences, including OSK1 peptide analog sequences, in accordance with the present invention. In the event an abbreviation listed in Table 1B differs from another abbreviation for the same substance disclosed elsewhere herein, both abbreviations are understood to be applicable.

| Abbreviation | Amino Acid |
|---|---|
| Sar | Sarcosine |
| Nle | norleucine |
| Ile | isoleucine |
| 1-Nal | 3-(1-naphthyl)alanine |
| 2-Nal | 3-(2-naphthyl)alanine |
| Bip | 4,4'-biphenyl alanine |
| Dip | 3,3-diphenylalanine |
| Nvl | norvaline |
| NMe-Val | Nα-methyl valine |
| NMe-Leu | Nα-methyl leucine |
| NMe-Nle | Nα-methyl norleucine |
| Cpg | cyclopentyl glycine |

-continued

| Abbreviation | Amino Acid |
|---|---|
| Chg | cyclohexyl glycine |
| Hyp | hydroxy proline |
| Oic | Octahydroindole-2-Carboxylic Acid |
| Igl | Indanyl glycine |
| Aib | aminoisobutyric acid |
| Aic | 2-aminoindane-2-carboxylic acid |
| Pip | pipecolic acid |
| BhTic | β-homo Tic |
| BhPro | β-homo proline |
| Sar | Sarcosine |
| Cpg | cyclopentyl glycine |
| Tiq | 1,2,3,4-L-Tetrahydroisoquinoline-1-Carboxylic acid |
| Nip | Nipecotic Acid |
| Thz | Thiazolidine-4-carboxylic acid |
| Thi | 3-thienyl alanine |
| 4GuaPr | 4-guanidino proline |
| 4Pip | 4-Amino-1-piperidine-4-carboxylic acid |
| Idc | indoline-2-carboxylic acid |
| Hydroxyl-Tic | 1,2,3,4-Tetrahydroisoquinoline-7-hydroxy-3-carboxylic acid |
| Bip | 4,4'-biphenyl alanine |
| Ome-Tyr | O-methyl tyrosine |
| I-Tyr | Iodotyrosine |
| Tic | 1,2,3,4-L-Tetrahydroisoquinoline-3-Carboxylic acid |
| Igl | Indanyl glycine |
| BhTic | β-homo Tic |
| BhPhe | β-homo phenylalanine |
| AMeF | α-methyl Phenyalanine |
| BPhe | β-phenylalanine |
| Phg | phenylglycine |
| Anc | 3-amino-2-naphthoic acid |
| Atc | 2-aminotetraline-2-carboxylic acid |
| NMe-Phe | Nα-methyl phenylalanine |
| NMe-Lys | Nα-methyl lysine |
| Tpi | 1,2,3,4-Tetrahydronorharman-3-Carboxylic acid |
| Cpg | cyclopentyl glycine |
| Dip | 3,3-diphenylalanine |
| 4Pal | 4-pyridinylalanine |
| 3Pal | 3-pyridinylalanine |
| 2Pal | 2-pyridinylalanine |
| 4Pip | 4-Amino-1-piperidine-4-carboxylic acid |
| 4AmP | 4-amino-phenylalanine |
| Idc | indoline-2-carboxylic acid |
| Chg | cyclohexyl glycine |
| hPhe | homophenylalanine |
| BhTrp | β-homotryptophan |
| pI-Phe | 4-iodophenylalanine |
| Aic | 2-aminoindane-2-carboxylic acid |
| NMe-Lys | Nα-methyl lysine |
| Orn | ornithine |
| Dpr | 2,3-Diaminopropionic acid |
| Dbu | 2,4-Diaminobutyric acid |
| homoLys | homolysine |
| N-eMe-K | Nε-methyl-lysine |
| N-eEt-K | Nε-ethyl-lysine |
| N-eIPr-K | Nε-isopropyl-lysine |
| bhomoK | β-homolysine |
| rLys | Lys ψ($CH_2NH$)-reduced amide bond |
| rOrn | Orn ψ($CH_2NH$)-reduced amide bond |
| Acm | acetamidomethyl |
| Ahx | 6-aminohexanoic acid |
| εAhx | 6-aminohexanoic acid |
| K(NPeg11) | Nε-(O-(aminoethyl)-O'-(2-propanoyl)-undecaethyleneglycol)-Lysine |
| K(NPeg27) | Nε-(O-(aminoethyl)-O'-(2-propanoyl)-(ethyleneglycol)27-Lysine |
| Cit | Citrulline |
| hArg | homoarginine |
| hCit | homocitrulline |
| NMe-Arg | Nα-methyl arginine (NMeR) |
| Guf | 4-guanidinyl phenylalanine |
| bhArg | β-homoarginine |
| 3G-Dpr | 2-amino-3-guanidinopropanoic acid |
| 4AmP | 4-amino-phenylalanine |
| 4AmPhe | 4-amidino-phenylalanine |

-continued

| Abbreviation | Amino Acid |
|---|---|
| 4AmPig | 2-amino-2-(1-carbamimidoylpiperidin-4-yl)acetic acid |
| 4GuaPr | 4-guanidino proline |
| N-Arg | Nα-[$(CH_2)_3NHCH(NH)NH_2$] substituted glycine |
| rArg | Arg ψ($CH_2NH$)-reduced amide bond |
| 4PipA | 4-Piperidinyl alanine |
| NMe-Arg | Nα-methyl arginine (or NMeR) |
| NMe-Thr | Nα-methyl threonine (or NMeThr) |

Nomenclature and Symbolism for Amino Acids and Peptides by the UPAC-IUB Joint Commission on Biochemical Nomenclature (JCBN) have been published in the following documents: Biochem. J., 1984, 219, 345-373; Eur. J. Biochem., 1984, 138, 9-37; 1985, 152, 1; 1993, 213, 2; Internat. J. Pept. Prot. Res., 1984, 24, following p 84; J. Biol. Chem., 1985, 260, 14-42; Pure Appl. Chem., 1984, 56, 595-624; Amino Acids and Peptides, 1985, 16, 387-410; Biochemical Nomenclature and Related Documents, 2nd edition, Portland Press, 1992, pages 39-69].

As stated herein, in accordance with the present invention, peptide portions of the inventive compositions, such as the toxin peptide or a peptide linker, can also be chemically derivatized at one or more amino acid residues. Peptides that contain derivatized amino acid residues can be synthesized by known organic chemistry techniques. "Chemical derivative" or "chemically derivatized" in the context of a peptide refers to a subject peptide having one or more residues chemically derivatized by reaction of a functional side group. Such derivatized molecules include, for example, those molecules in which free amino groups have been derivatized to form amine hydrochlorides, p-toluene sulfonyl groups, carbobenzoxy groups, t-butyloxycarbonyl groups, chloroacetyl groups or formyl groups. Free carboxyl groups may be derivatized to form salts, methyl and ethyl esters or other types of esters or hydrazides. Free hydroxyl groups may be derivatized to form O-acyl or O-alkyl derivatives. The imidazole nitrogen of histidine may be derivatized to form N-im-benzylhistidine. Also included as chemical derivatives are those peptides which contain one or more naturally occurring amino acid derivatives of the twenty canonical amino acids, whether in L- or D-form. For example, 4-hydroxyproline may be substituted for proline; 5-hydroxylysine maybe substituted for lysine; 3-methylhistidine may be substituted for histidine; homoserine may be substituted for serine; and ornithine may be substituted for lysine.

Useful derivatizations include, in some embodiments, those in which the amino terminal of the toxin peptide, such as but not limited to the OSK1 peptide analog, is chemically blocked so that conjugation with the vehicle will be prevented from taking place at an N-terminal free amino group. There may also be other beneficial effects of such a modification, for example a reduction in the toxin peptide's susceptibility to enzymatic proteolysis. The N-terminus of the toxin peptide, e.g., the OSK1 peptide analog, can be acylated or modified to a substituted amine, or derivatized with another functional group, such as an aromatic or aryl moiety (e.g., an indole acid, benzyl (Bzl or Bn), dibenzyl (DiBzl or $Bn_2$), benzoyl, or benzyloxycarbonyl (Cbz or Z)), N,N-dimethylglycine or creatine. For example, in some embodiments, an acyl moiety, such as, but not limited to, a formyl, acetyl (Ac), propanoyl, butanyl, heptanyl, hexanoyl, octanoyl, or nonanoyl, can be covalently linked to the N-terminal end of the peptide, e.g., the OSK1 peptide analog, which can prevent undesired side reactions during conjugation of the vehicle to the peptide. Alternatively, a fatty acid (e.g. butyric, caproic, caprylic, capric, lauric, myristic, palmitic, stearic or the like) or polyethylene glycol moiety can be covalently linked to the N-terminal end of the peptide, e.g., the OSK1 peptide analog. Other exemplary N-terminal derivative groups include —$NRR^1$ (other than —$NH_2$), —$NRC(O)R^1$, —$NRC(O)OR^1$, —$NRS(O)_2R^1$, —$NHC(O)NHR^1$, succinimide, or benzyloxycarbonyl-NH-(Cbz-NH—), wherein R and $R^1$ are each independently hydrogen or lower alkyl and wherein the phenyl ring may be substituted with 1 to 3 substituents selected from $C_1$-$C_4$ alkyl, $C_1$-$C_4$ alkoxy, chloro, and bromo.

In some embodiments of the present invention, basic residues (e.g., lysine) of the toxin peptide of interest can be replaced with other residues (nonfunctional residues preferred). Such molecules will be less basic than the molecules from which they are derived and otherwise retain the activity of the molecules from which they are derived, which can result in advantages in stability and immunogenicity; the present invention should not, however, be limited by this theory.

Additionally, physiologically acceptable salts of the inventive compositions are also encompassed, including when the inventive compositions are referred to herein as "molecules" or "compounds.". By "physiologically acceptable salts" is meant any salts that are known or later discovered to be pharmaceutically acceptable. Some non-limiting examples of pharmaceutically acceptable salts are: acetate; trifluoroacetate; hydrohalides, such as hydrochloride and hydrobromide; sulfate; citrate; maleate; tartrate; glycolate; gluconate; succinate; mesylate; besylate; salts of gallic acid esters (gallic acid is also known as 3, 4, 5 trihydroxybenzoic acid) such as PentaGalloylGlucose (PGG) and epigallocatechin gallate (EGCG), salts of cholesteryl sulfate, pamoate, tannate and oxalate salts.

Structure of Compounds:

In general. Recombinant proteins have been developed as therapeutic agents through, among other means, covalent attachment to half-life extending moieties. Such moieties include the "Fc" domain of an antibody, as is used in Enbrel® (etanercept), as well as biologically suitable polymers (e.g., polyethylene glycol, or "PEG"), as is used in Neulasta® (pegfilgrastim). Feige et al. described the use of such half-life extenders with peptides in U.S. Pat. No. 6,660,843, issued Dec. 9, 2003 (hereby incorporated by reference in its entirety).

The present inventors have determined that molecules of this invention-peptides of about 80 amino acids or less with at least two intrapeptide disulfide bonds-possess therapeutic advantages when covalently attached to half-life extending moieties. Molecules of the present invention can further comprise an additional pharmacologically active, covalently bound peptide, which can be bound to the half-life extending moiety ($F^1$ and/or $F^2$) or to the peptide portion (P). Embodiments of the inventive compositions containing more than one half-life extending moiety ($F^1$ and $F^2$) include those in which $F^1$ and $F^2$ are the same or different half-life extending moieties. Examples (with or without a linker between each domain) include structures as illustrated in FIG. 75 as well as the following embodiments (and others described herein and in the working Examples):

20KPEG—toxin peptide—Fc domain, consistent with the formula $[(F^1)_1—(X^2)_1—(F^2)_1]$;

20KPEG—toxin peptide—Fc CH2 domain, consistent with the formula $[(F^1)_1—(X^2)_1—(F^2)_1]$;

20KPEG—toxin peptide—HSA, consistent with the formula $[(F^1)_1(X^2)_1—(F^2)_1]$;

20KPEG—Fc domain—toxin peptide, consistent with the formula $[(F^1)_1—(F^2)_1—(X^3)_1]$;

20KPEG—Fc CH2 domain—toxin peptide, consistent with the formula $[(F^1)_1—(F^2)_1—(X^3)_1]$; and 20KPEG—HSA—toxin peptide, consistent with the formula $[(F^1)_1—(F^2)_1—(X^3)_1]$.

Toxin peptides. Any number of toxin peptides (i.e., "P", or equivalently shown as "$P^1$" in FIG. 2) can be used in conjunction with the present invention. Of particular interest are the toxin peptides ShK, HmK, MgTx, AgTx2, Agatoxins, and HsTx1, as well as modified analogs of these, in particular OsK1 (also referred to as "OSK1") peptide analogs of the present invention, and other peptides that mimic the activity of such toxin peptides. As stated herein above, if more than one toxin peptide "P" is present in the inventive composition, "P" can be independently the same or different from any other toxin peptide(s) also present in the inventive composition. For example, in a composition having the formula $P-(L)_g-F^1-(L)_f-P$, both of the toxin peptides, "P", can be the same peptide analog of ShK, different peptide analogs of ShK, or one can be a peptide analog of ShK and the other a peptide analog of OSK1. In a preferred embodiment, at least one P is a an OSK1 peptide analog as further described herein.

In some embodiments of the invention, other peptides of interest are especially useful in molecules having additional features over the molecules of structural Formula I. In such molecules, the molecule of Formula I further comprises an additional pharmacologically active, covalently bound peptide, which is an agonistic peptide, an antagonistic peptide, or a targeting peptide; this peptide can be conjugated to $F^1$ or $F^2$ or P. Such agonistic peptides have activity agonistic to the toxin peptide but are not required to exert such activity by the same mechanism as the toxin peptide. Peptide antagonists are also useful in embodiments of the invention, with a preference for those with activity that can be complementary to the activity of the toxin peptide. Targeting peptides are also of interest, such as peptides that direct the molecule to particular cell types, organs, and the like. These classes of peptides can be discovered by methods described in the references cited in this specification and other references. Phage display, in particular, is useful in generating toxin peptides for use in the present invention. Affinity selection from libraries of random peptides can be used to identify peptide ligands for any site of any gene product. Dedman et al. (1993), *J. Biol. Chem.* 268: 23025-30. Phage display is particularly well suited for identifying peptides that bind to such proteins of interest as cell surface receptors or any proteins having linear epitopes. Wilson et al. (1998), *Can. J. Microbiol.* 44: 313-29; Kay et al. (1998), *Drug Disc. Today* 3: 370-8. Such proteins are extensively reviewed in Herz et al. (1997), *J. Receptor and Signal Transduction Res.* 17(5): 671-776, which is hereby incorporated by reference in its entirety. Such proteins of interest are preferred for use in this invention.

Particularly preferred peptides appear in the following tables. These peptides can be prepared by methods disclosed in the art or as described hereinafter. Single letter amino acid abbreviations are used. Unless otherwise specified, each X is independently a nonfunctional residue.

TABLE 1

Kv1.3 inhibitor peptide sequences

| Sequence/structure | Short-hand designation | SEQ ID NO: |
|---|---|---|
| LVKCRGTSDCGRPCQQQTGCPNSKCINRMCKCYGC | Pi1 | 21 |
| TISCTNPKQCYPHCKKETGYPNAKCMNRKCKCFGR | Pi2 | 17 |
| TISCTNEKQCYPHCKKETGYPNAKCMNRKCKCFGR | Pi3 | 18 |
| IEAIRCGGSRDCYRPCQKRTGCPNAKCINKTCKCYGCS | Pi4 | 19 |
| ASCRTPKDCADPCRKETGCPYGKCMNRKCKCNRC | HsTx1 | 61 |
| GVPINVSCTGSPQCIKPCKDAGMRFGKCMNRKCHCTPK | AgTx2 | 23 |
| GVPINVKCTGSPQCLKPCKDAGMRFGKCINGKCHCTPK | AgTx1 | 85 |
| GVIINVKCKISRQCLEPCKKAGMRFGKCMNGKCHCTPK | OSK1 | 25 |
| ZKECTGPQHCTNFCRKNKCTHGKCMNRKCKCFNCK | Anuroctoxin | 62 |
| TIINVKCTSPKQCSKPCKELYGSSAGAKCMNGKCKCYNN | NTX | 30 |
| TVIDVKCTSPKQCLPPCKAQFGIRAGAKCMNGKCKCYPH | HgTx1 | 27 |
| QFTNVSCTTSKECWSVCQRLHNTSRGKCMNKKCRCYS | ChTx | 36 |
| VFINAKCRGSPECLPKCKEAIGKAAGKCMNGKCKCYP | Titystoxin-Ka | 86 |
| VCRDWFKETACRHAKSLGNCRTSQKYRANCAKTCELC | BgK | 9 |
| VGINVKCKHSGQCLKPCKDAGMRFGKCINGKCDCTPKG | BmKTX | 26 |
| QFTDVKCTGSKQCWPVCKQMFGKPNGKCMNGKCRCYS | BmTx1 | 40 |
| VFINVKCRGSKECLPACKAAVGKAAGKCMNGKCKCYP | Tc30 | 87 |
| TGPQTTCQAAMCEAGCKGLGKSMESCQGDTCKCKA | Tc32 | 13 |

TABLE 2

ShK peptide and ShK peptide analog sequences

| Sequence/structure | Short-hand designation | SEQ ID NO: |
|---|---|---|
| RSCIDTIPKSRCTAFQCKHSMKYRLSFCRKTCGTC | ShK | 5 |
| RSCIDTIPKSRCTAFQSKHSMKYRLSFCRKTSGTC | ShK-S17/S32 | 88 |
| RSSIDTIPKSRCTAFQCKHSMKYRLSFCRKTCGTS | ShK-S3/S35 | 89 |
| SSCIDTIPKSRCTAFQCKHSMKYRLSFCRKTCGTC | ShK-S1 | 90 |
| (N-acetylarg) SCIDTIPKSRCTAFQCKHSMKYRLSFCRKTCGTC | ShK-N-acetylarg1 | 91 |
| SCIDTIPKSRCTAFQCKHSMKYRLSFCRKTCGTC | ShK-d1 | 92 |
| CIDTIPKSRCTAFQCKHSMKYRLSFCRKTCGTC | ShK-d2 | 93 |
| ASCIDTIPKSRCTAFQCKHSMKYRLSFCRKTCGTC | ShK-A1 | 94 |
| RSCADTIPKSRCTAFQCKHSMKYRLSFCRKTCGTC | ShK-A4 | 95 |
| RSCADTIPKSRCTAAQCKHSMKYRLSFCRKTCGTC | ShK-A4/A15 | 96 |
| RSCADTIPKSRCTAAQCKHSMKYRASFCRKTCGTC | ShK-A4/A15/A25 | 97 |
| RSCIDAIPKSRCTAFQCKHSMKYRLSFCRKTCGTC | ShK-A6 | 98 |
| RSCIDTAPKSRCTAFQCKHSMKYRLSFCRKTCGTC | ShK-A7 | 99 |
| RSCIDTIAKSRCTAFQCKHSMKYRLSFCRKTCGTC | ShK-A8 | 100 |
| RSCIDTIPASRCTAFQCKHSMKYRLSFCRKTCGTC | ShK-A9 | 101 |
| RSCIDTIPESRCTAFQCKHSMKYRLSFCRKTCGTC | ShK-E9 | 102 |
| RSCIDTIPQSRCTAFQCKHSMKYRLSFCRKTCGTC | ShK-Q9 | 103 |
| RSCIDTIPKARCTAFQCKHSMKYRLSFCRKTCGTC | ShK-A10 | 104 |
| RSCIDTIPKSACTAFQCKHSMKYRLSFCRKTCGTC | ShK-A11 | 105 |
| RSCIDTIPKSECTAFQCKHSMKYRLSFCRKTCGTC | ShK-E11 | 106 |
| RSCIDTIPKSQCTAFQCKHSMKYRLSFCRKTCGTC | ShK-Q11 | 107 |
| RSCIDTIPKSRCAAFQCKHSMKYRLSFCRKTCGTC | ShK-A13 | 108 |
| RSCIDTIPKSRCTAAQCKHSMKYRLSFCRKTCGTC | ShK-A15 | 109 |
| RSCIDTIPKSRCTAWQCKHSMKYRLSFCRKTCGTC | ShK-W15 | 110 |
| RSCIDTIPKSRCTA$X^{s15}$QCKHSMKYRLSFCRKTCGTC | ShK-X15 | 111 |
| RSCIDTIPKSRCTAAQCKHSMKYRASFCRKTCGTC | ShK-A15/A25 | 112 |
| RSCIDTIPKSRCTAFACKHSMKYRLSFCRKTCGTC | ShK-A16 | 113 |
| RSCIDTIPKSRCTAFECKHSMKYRLSFCRKTCGTC | ShK-E16 | 114 |
| RSCIDTIPKSRCTAFQCAHSMKYRLSFCRKTCGTC | ShK-A18 | 115 |
| RSCIDTIPKSRCTAFQCEHSMKYRLSFCRKTCGTC | ShK-E18 | 116 |
| RSCIDTIPKSRCTAFQCKASMKYRLSFCRKTCGTC | ShK-A19 | 117 |
| RSCIDTIPKSRCTAFQCKKSMKYRLSFCRKTCGTC | ShK-K19 | 118 |
| RSCIDTIPKSRCTAFQCKHAMKYRLSFCRKTCGTC | ShK-A20 | 119 |
| RSCIDTIPKSRCTAFQCKHSAKYRLSFCRKTCGTC | ShK-A21 | 120 |
| RSCIDTIPKSRCTAFQCKHS$X^{s21}$KYRLSFCRKTCGTC | ShK-X21 | 121 |
| RSCIDTIPKSRCTAFQCKHS(norleu)KYRLSFCRKTCGTC | ShK-Nle21 | 122 |
| RSCIDTIPKSRCTAFQCKHSMAYRLSFCRKTCGTC | ShK-A22 | 123 |

TABLE 2-continued

ShK peptide and ShK peptide analog sequences

| Sequence/structure | Short-hand designation | SEQ ID NO: |
|---|---|---|
| RSCIDTIPKSRCTAFQCKHSMEYRLSFCRKTCGTC | ShK-E22 | 124 |
| RSCIDTIPKSRCTAFQCKHSMRYRLSFCRKTCGTC | ShK-R22 | 125 |
| RSCIDTIPKSRCTAFQCKHSM$X^{s22}$YRLSFCRKTCGTC | ShK-X22 | 126 |
| RSCIDTIPKSRCTAFQCKHSM(norleu)YRLSFCRKTCGTC | ShK-Nle22 | 127 |
| RSCIDTIPKSRCTAFQCKHSM(orn)YRLSFCRKTCGTC | ShK-Orn22 | 128 |
| RSCIDTIPKSRCTAFQCKHSM(homocit)YRLSFCRKTCGTC | ShK-Homocit22 | 129 |
| RSCIDTIPKSRCTAFQCKHSM(diaminopropionic)YRLS FCRKTCGTC | ShK-Diamino-propionic22 | 130 |
| RSCIDTIPKSRCTAFQCKHSMKARLSFCRKTCGTC | ShK-A23 | 131 |
| RSCIDTIPKSRCTAFQCKHSMKSRLSFCRKTCGTC | ShK-S23 | 132 |
| RSCIDTIPKSRCTAFQCKHSMKFRLSFCRKTCGTC | ShK-F23 | 133 |
| RSCIDTIPKSRCTAFQCKHSMK$X^{s23}$RLSFCRKTCGTC | ShK-X23 | 134 |
| RSCIDTIPKSRCTAFQCKHSMK(nitrophe)RLSECRKTCGTC | ShK-Nitrophe23 | 135 |
| RSCIDTIPKSRCTAFQCKHSMK(aminophe)RLSFCRKTCGTC | ShK-Aminophe23 | 136 |
| RSCIDTIPKSRCTAFQCKHSMK(benzylphe)RLSFCRKTCG TC | ShK-Benzylphe23 | 137 |
| RSCIDTIPKSRCTAFQCKHSMKYALSFCRKTCGTC | ShK-A24 | 138 |
| RSCIDTIPKSRCTAFQCKHSMKYELSFCRKTCGTC | ShK-E24 | 139 |
| RSCIDTIPKSRCTAFQCKHSMKYRASFCRKTCGTC | ShK-A25 | 140 |
| RSCIDTIPKSRCTAFQCKHSMKYRLAFCRKTCGTC | ShK-A26 | 141 |
| RSCIDTIPKSRCTAFQCKHSMKYRLSACRKTCGTC | ShK-A27 | 142 |
| RSCIDTIPKSRCTAFQCKHSMKYRLS$X^{s27}$CRKTCGTC | ShK-X27 | 143 |
| RSCIDTIPKSRCTAFQCKHSMKYRLSFCAKTCGTC | ShK-A29 | 144 |
| RSCIDTIPKSRCTAFQCKHSMKYRLSFCRATCGTC | ShK-A30 | 145 |
| RSCIDTIPKSRCTAFQCKHSMKYRLSFCRKACGTC | ShK-A31 | 146 |
| RSCIDTIPKSRCTAFQCKHSMKYRLSFCRKTCGAC | ShK-A34 | 147 |
| SCADTIPKSRCTAFQCKHSMKYRLSFCRKTCGTC | ShK-A4d1 | 148 |
| SCADTIPKSRCTAAQCKHSMKYRLSFCRKTCGTC | ShK-A4/A15d1 | 149 |
| SCADTIPKSRCTAAQCKHSMKYRASFCRKTCGTC | ShK-A4/A15/A25 d1 | 150 |
| SCIDAIPKSRCTAFQCKHSMKYRLSFCRKTCGTC | ShK-A6 d1 | 151 |
| SCIDTAPKSRCTAFQCKHSMKYRLSFCRKTCGTC | ShK-A7 d1 | 152 |
| SCIDTIAKSRCTAFQCKHSMKYRLSFCRKTCGTC | ShK-A8 d1 | 153 |
| SCIDTIPASRCTAFQCKHSMKYRLSFCRKTCGTC | ShK-A9 d1 | 154 |
| SCIDTIPESRCTAFQCKHSMKYRLSFCRKTCGTC | ShK-E9 d1 | 155 |
| SCIDTIPQSRCTAFQCKHSMKYRLSFCRKTCGTC | ShK-Q9 d1 | 156 |
| SCIDTIPKARCTAFQCKHSMKYRLSFCRKTCGTC | ShK-A10 d1 | 157 |
| SCIDTIPKSACTAFQCKHSMKYRLSFCRKTCGTC | ShK-A11 d1 | 158 |

TABLE 2-continued

ShK peptide and ShK peptide analog sequences

| Sequence/structure | Short-hand designation | SEQ ID NO: |
|---|---|---|
| SCIDTIPKSECTAFQCKHSMKYRLSFCRKTCGTC | ShK-E11 d1 | 159 |
| SCIDTIPKSQCTAFQCKHSMKYRLSFCRKTCGTC | ShK-Q11 d1 | 160 |
| SCIDTIPKSRCAAFQCKHSMKYRLSFCRKTCGTC | ShK-A13 d1 | 161 |
| SCIDTIPKSRCTAAQCKHSMKYRLSFCRKTCGTC | ShK-A15 d1 | 162 |
| SCIDTIPKSRCTAWQCKHSMKYRLSFCRKTCGTC | ShK-W15 d1 | 163 |
| SCIDTIPKSRCTAX$^{s15}$QCKHSMKYRLSFCRKTCGTC | ShK-X15 d1 | 164 |
| SCIDTIPKSRCTAAQCKHSMKYRASFCRKTCGTC | ShK-A15/A25 d1 | 165 |
| SCIDTIPKSRCTAFACKHSMKYRLSFCRKTCGTC | ShK-A16 d1 | 166 |
| SCIDTIPKSRCTAFECKHSMKYRLSFCRKTCGTC | ShK-E16 d1 | 167 |
| SCIDTIPKSRCTAFQCAHSMKYRLSFCRKTCGTC | ShK-A18 d1 | 168 |
| SCIDTIPKSRCTAFQCEHSMKYRLSFCRKTCGTC | ShK-E18 d1 | 169 |
| SCIDTIPKSRCTAFQCKASMKYRLSFCRKTCGTC | ShK-A19 d1 | 170 |
| SCIDTIPKSRCTAFQCKKSMKYRLSFCRKTCGTC | ShK-K19 d1 | 171 |
| SCIDTIPKSRCTAFQCKHAMKYRLSFCRKTCGTC | ShK-A20 d1 | 172 |
| SCIDTIPKSRCTAFQCKHSAKYRLSFCRKTCGTC | ShK-A21 d1 | 173 |
| SCIDTIPKSRCTAFQCKHSX$^{s21}$KYRLSFCRKTCGTC | ShK-X21 d1 | 174 |
| SCIDTIPKSRCTAFQCKHS(norleu)KYRLSFCRKTCGTC | ShK-Nle21 d1 | 175 |
| SCIDTIPKSRCTAFQCKHSMAYRLSFCRKTCGTC | ShK-A22 d1 | 176 |
| SCIDTIPKSRCTAFQCKHSMEYRLSFCRKTCGTC | ShK-E22 d1 | 177 |
| SCIDTIPKSRCTAFQCKHSMRYRLSFCRKTCGTC | ShK-R22 d1 | 178 |
| SCIDTIPKSRCTAFQCKHSMX$^{s22}$YRLSFCRKTCGTC | ShK-X22 d1 | 179 |
| SCIDTIPKSRCTAFQCKHSM(norleu)YRLSFCRKTCGTC | ShK-Nle22 d1 | 180 |
| SCIDTIPKSRCTAFQCKHSM(orn)YRLSFCRKTCGTC | ShK-Orn22 d1 | 181 |
| SCIDTIPKSRCTAFQCKHSM(homocit)YRLSFCRKTCGTC | ShK-Homocit22 d1 | 182 |
| SCIDTIPKSRCTAFQCKHSM(diaminopropionic)YRLSF CRKTCGTC | ShK-Diamino-propionic22 d1 | 183 |
| SCIDTIPKSRCTAFQCKHSMKARLSFCRKTCGTC | ShK-A23 d1 | 184 |
| SCIDTIPKSRCTAFQCKHSMKSRLSFCRKTCGTC | ShK-S23 d1 | 185 |
| SCIDTIPKSRCTAFQCKHSMKFRLSFCRKTCGTC | ShK-F23 d1 | 186 |
| SCIDTIPKSRCTAFQCKHSMKX$^{s23}$RLSFCRKTCGTC | ShK-X23 d1 | 187 |
| SCIDTIPKSRCTAFQCKHSMK(nitrophe)RLSFCRKTCGTC | ShK-Nitrophe23 d1 | 188 |
| SCIDTIPKSRCTAFQCKHSMK(aminophe)RLSFCRKTCGTC | ShK-Aminophe23 d1 | 189 |
| SCIDTIPKSRCTAFQCKHSMK(benzylphe)RLSFCRKTCGTC | ShK-Benzylphe23 d1 | 190 |
| SCIDTIPKSRCTAFQCKHSMKYALSFCRKTCGTC | ShK-A24 d1 | 191 |
| SCIDTIPKSRCTAFQCKHSMKYELSFCRKTCGTC | ShK-E24 d1 | 192 |
| SCIDTIPKSRCTAFQCKHSMKYRASFCRKTCGTC | ShK-A25 d1 | 193 |

TABLE 2-continued

ShK peptide and ShK peptide analog sequences

| Sequence/structure | Short-hand designation | SEQ ID NO: |
|---|---|---|
| SCIDTIPKSRCTAFQCKHSMKYRLAFCRKTCGTC | ShK-A26 d1 | 194 |
| SCIDTIPKSRCTAFQCKHSMKYRLSACRKTCGTC | ShK-A27 d1 | 195 |
| SCIDTIPKSRCTAFQCKHSMKYRLSX$^{s27}$CRKTCGTC | ShK-X27 d1 | 196 |
| SCIDTIPKSRCTAFQCKHSMKYRLSFCAKTCGTC | ShK-A29 d1 | 197 |
| SCIDTIPKSRCTAFQCKHSMKYRLSFCRATCGTC | ShK-A30 d1 | 198 |
| SCIDTIPKSRCTAFQCKHSMKYRLSFCRKACGTC | ShK-A31 d1 | 199 |
| SCIDTIPKSRCTAFQCKHSMKYRLSFCRKTCGAC | ShK-A34 d1 | 200 |
| YSCIDTIPKSRCTAFQCKHSMKYRLSFCRKTCGTC | ShK-Y1 | 548 |
| KSCIDTIPKSRCTAFQCKHSMKYRLSFCRKTCGTC | ShK-K1 | 549 |
| HSCIDTIPKSRCTAFQCKHSMKYRLSFCRKTCGTC | ShK-H1 | 550 |
| QSCIDTIPKSRCTAFQCKHSMKYRLSFCRKTCGTC | ShK-Q1 | 551 |
| PPRSCIDTIPKSRCTAFQCKHSMKYRLSFCRKTCGTC | PP-ShK | 552 |
| MRSCIDTIPKSRCTAFQCKHSMKYRLSFCRKTCGTC | M-ShK | 553 |
| GRSCIDTIPKSRCTAFQCKHSMKYRLSFCRKTCGTC | G-ShK | 554 |
| YSCIDTIPKSRCTAFQCKHSMAYRLSFCRKTCGTC | ShK-Y1/A22 | 555 |
| KSCIDTIPKSRCTAFQCKHSMAYRLSFCRKTCGTC | ShK-K1/A22 | 556 |
| HSCIDTIPKSRCTAFQCKHSMAYRLSFCRKTCGTC | ShK-H1/A22 | 557 |
| QSCIDTIPKSRCTAFQCKHSMAYRLSFCRKTCGTC | ShK-Q1/A22 | 558 |
| PPRSCIDTIPKSRCTAFQCKHSMAYRLSFCRKTCGTC | PP-ShK-A22 | 559 |
| MRSCIDTIPKSRCTAFQCKHSMAYRLSFCRKTCGTC | M-ShK-A22 | 560 |
| GRSCIDTIPKSRCTAFQCKHSMAYRLSFCRKTCGTC | G-ShK-A22 | 561 |
| RSCIDTIPASRCTAFQCKHSMAYRLSFCRKTCGTC | ShK-A9/A22 | 884 |
| SCIDTIPASRCTAFQCKHSMAYRLSFCRKTCGTC | ShK-A9/A22 d1 | 885 |
| RSCIDTIPVSRCTAFQCKHSMKYRLSFCRKTCGTC | ShK-V9 | 886 |
| RSCIDTIPVSRCTAFQCKHSMAYRLSFCRKTCGTC | ShK-V9/A22 | 887 |
| SCIDTIPVSRCTAFQCKHSMKYRLSFCRKTCGTC | ShK-V9 d1 | 888 |
| SCIDTIPVSRCTAFQCKHSMAYRLSFCRKTCGTC | ShK-V9/A22 d1 | 889 |
| RSCIDTIPESRCTAFQCKHSMAYRLSFCRKTCGTC | ShK-E9/A22 | 890 |
| SCIDTIPESRCTAFQCKHSMAYRLSFCRKTCGTC | ShK-E9/A22 d1 | 891 |
| RSCIDTIPKSACTAFQCKHSMAYRLSFCRKTCGTC | ShK-A11/A22 | 892 |
| SCIDTIPKSACTAFQCKHSMAYRLSFCRKTCGTC | ShK-A11/22 d1 | 893 |
| RSCIDTIPKSECTAFQCKHSMAYRLSFCRKTCGTC | ShK-E11/A22 | 894 |
| SCIDTIPKSECTAFQCKHSMAYRLSFCRKTCGTC | ShK-E11/A22 d1 | 895 |
| RSCIDTIPKSRCTDFQCKHSMKYRLSFCRKTCGTC | ShK-D14 | 896 |
| RSCIDTIPKSRCTDFQCKHSMAYRLSFCRKTCGTC | ShK-D14/A22 | 897 |
| SCIDTIPKSRCTDFQCKHSMKYRLSFCRKTCGTC | ShK-D14 d1 | 898 |
| SCIDTIPKSRCTDFQCKHSMAYRLSFCRKTCGTC | ShK-D14/A22 d1 | 899 |

TABLE 2-continued

ShK peptide and ShK peptide analog sequences

| Sequence/structure | Short-hand designation | SEQ ID NO: |
|---|---|---|
| RSCIDTIPKSRCTAAQCKHSMAYRLSFCRKTCGTC | ShK-A15A/22 | 900 |
| SCIDTIPKSRCTAAQCKHSMAYRLSFCRKTCGTC | ShK-A15/A22 d1 | 901 |
| RSCIDTIPKSRCTAIQCKHSMKYRLSFCRKTCGTC | ShK-I15 | 902 |
| RSCIDTIPKSRCTAIQCKHSMAYRLSFCRKTCGTC | ShK-I15/A22 | 903 |
| SCIDTIPKSRCTAIQCKHSMKYRLSFCRKTCGTC | ShK-I15 d1 | 904 |
| SCIDTIPKSRCTAIQCKHSMAYRLSFCRKTCGTC | ShK-I15/A22 d1 | 905 |
| RSCIDTIPKSRCTAVQCKHSMKYRLSFCRKTCGTC | ShK-V15 | 906 |
| RSCIDTIPKSRCTAVQCKHSMAYRLSFCRKTCGTC | ShK-V15/A22 | 907 |
| SCIDTIPKSRCTAVQCKHSMKYRLSFCRKTCGTC | ShK-V15 d1 | 908 |
| SCIDTIPKSRCTAVQCKHSMAYRLSFCRKTCGTC | ShK-V15/A22 d1 | 909 |
| RSCIDTIPKSRCTAFRCKHSMKYRLSFCRKTCGTC | ShK-R16 | 910 |
| RSCIDTIPKSRCTAFRCKHSMAYRLSFCRKTCGTC | ShK-R16/A22 | 911 |
| SCIDTIPKSRCTAFRCKHSMKYRLSFCRKTCGTC | ShK-R16 d1 | 912 |
| SCIDTIPKSRCTAFRCKHSMAYRLSFCRKTCGTC | ShK-R16/A22 d1 | 913 |
| RSCIDTIPKSRCTAFKCKHSMKYRLSFCRKTCGTC | ShK-K16 | 914 |
| RSCIDTIPKSRCTAFKCKHSMAYRLSFCRKTCGTC | ShK-K16/A22 | 915 |
| SCIDTIPKSRCTAFKCKHSMKYRLSFCRKTCGTC | ShK-K16 d1 | 916 |
| SCIDTIPKSRCTAFKCKHSMAYRLSFCRKTCGTC | ShK-K16/A22 d1 | 917 |
| RSCIDTIPASECTAFQCKHSMKYRLSFCRKTCGTC | ShK-A9/E11 | 918 |
| RSCIDTIPASECTAFQCKHSMAYRLSFCRKTCGTC | ShK-A9/E11/A22 | 919 |
| SCIDTIPASECTAFQCKHSMKYRLSFCRKTCGTC | ShK-A9/E11 d1 | 920 |
| SCIDTIPASECTAFQCKHSMAYRLSFCRKTCGTC | ShK-A9/E11/A22 d1 | 921 |
| RSCIDTIPVSECTAFQCKHSMKYRLSFCRKTCGTC | ShK-V9/E11 | 922 |
| RSCIDTIPVSECTAFQCKHSMAYRLSFCRKTCGTC | ShK-V9/E11/A22 | 923 |
| SCIDTIPVSECTAFQCKHSMKYRLSFCRKTCGTC | ShK-V9/E11 d1 | 924 |
| SCIDTIPVSECTAFQCKHSMAYRLSFCRKTCGTC | ShK-V9/E11/A22 d1 | 925 |
| RSCIDTIPVSACTAFQCKHSMKYRLSFCRKTCGTC | ShK-V9/A11 | 926 |
| RSCIDTIPVSACTAFQCKHSMAYRLSFCRKTCGTC | ShK-V9/A11/A22 | 927 |
| SCIDTIPVSACTAFQCKHSMKYRLSFCRKTCGTC | ShK-V9/A11 d1 | 928 |
| SCIDTIPVSACTAFQCKHSMAYRLSFCRKTCGTC | ShK-V9/A11/A22 d1 | 929 |
| RSCIDTIPASACTAFQCKHSMKYRLSFCRKTCGTC | ShK-A9/A11 | 930 |
| RSCIDTIPASACTAFQCKHSMAYRLSFCRKTCGTC | ShK-A9/A11/A22 | 931 |
| SCIDTIPASACTAFQCKHSMKYRLSFCRKTCGTC | ShK-A9/A11 d1 | 932 |
| SCIDTIPASACTAFQCKHSMAYRLSFCRKTCGTC | ShK-A9/A11/A22 d1 | 933 |

TABLE 2-continued

| ShK peptide and ShK peptide analog sequences | | |
|---|---|---|
| Sequence/structure | Short-hand designation | SEQ ID NO: |
| RSCIDTIPKSECTDIRCKHSMKYRLSFCRKTCGTC | ShK-E11/D14/I15/R16 | 934 |
| RSCIDTIPKSECTDIRCKHSMAYRLSFCRKTCGTC | ShK-E11/D14/I15/R16/A22 | 935 |
| SCIDTIPKSECTDIRCKHSMKYRLSFCRKTCGTC | ShK-E11/D14/I15/R16 d1 | 936 |
| SCIDTIPKSECTDIRCKHSMAYRLSFCRKTCGTC | ShK-E11/D14/I15//R16 A22 d1 | 937 |
| RSCIDTIPVSECTDIRCKHSMKYRLSFCRKTCGTC | ShK-V9/E11/D14/I15/R16 | 938 |
| RSCIDTIPVSECTDIRCKHSMAYRLSFCRKTCGTC | ShK-V9/E11/D14/I15/R16/A22 | 939 |
| SCIDTIPVSECTDIRCKHSMKYRLSFCRKTCGTC | ShK-V9/E11/D14/I15/R16 d1 | 940 |
| SCIDTIPVSECTDIRCKHSMAYRLSFCRKTCGTC | ShK-V9/E11/D14/I15/R16/A22 d1 | 941 |
| RSCIDTIPVSECTDIQCKHSMKYRLSFCRKTCGTC | ShK-V9/E11/D14/I15 | 942 |
| RSCIDTIPVSECTDIQCKHSMAYRLSFCRKTCGTC | ShK-V9/E11/D14/I15/A22 | 943 |
| SCIDTIPVSECTDIQCKHSMKYRLSFCRKTCGTC | ShK-V9/E11/D14/I15 d1 | 944 |
| SCIDTIPVSECTDIQCKHSMAYRLSFCRKTCGTC | ShK-V9/E11/D14/I15/A 22 d1 | 945 |
| RTCKDLIPVSECTDIRCKHSMKYRLSFCRKTCGTC | ShK-T2/K4/L6/V9/E11/D14/I15/R16 | 946 |
| RTCKDLIPVSECTDIRCKHSMAYRLSFCRKTCGTC | ShK-T2/K4/L6/V9/E11/D14/I15/R16/A22 | 947 |
| TCKDLIPVSECTDIRCKHSMKYRLSFCRKTCGTC | ShK-T2/K4/L6/V9/E11/D14/I15/R16 d1 | 948 |
| TCKDLIPVSECTDIRCKHSMAYRLSFCRKTCGTC | ShK-T2/K4/L6/V9/E11/D14/I15/R16/A22 d1 | 949 |
| (L-Phosphotyrosine)-AEEARSCIDTIPKSRCTAFQCKHSMKYRLSFCRKTCGTC | ShK(L5) | 950 |
| QSCADTIPKSRCTAAQCKHSMKYRLSFCRKTCGTC | ShK Q1/A4/A15 | 1295 |
| QSCADTIPKSRCTAAQCKHSMAYRLSFCRKTCGTC | ShK Q1/A4/A15/A22 | 1296 |
| QSCADTIPKSRCTAAQCKHSM(Dap)YRLSFCRKTCGTC | ShK Q1/A4/A15/Dap22 | 1297 |

TABLE 2-continued

ShK peptide and ShK peptide analog sequences

| Sequence/structure | Short-hand designation | SEQ ID NO: |
|---|---|---|
| QSCADTIPKSRCTAAQCKHSMKYRASFCRKTCGTC | ShK Q1/A4/A15/A25 | 1298 |
| QSCADTIPKSRCTAAQCKHSMAYRASFCRKTCGTC | ShK Q1/A4/A15/A22/A25 | 1299 |
| QSCADTIPKSRCTAAQCKHSM(Dap)YRASFCRKTCGTC | ShK Q1/A4/A15/Dap22/A25 | 1300 |

Many peptides as described in Table 2 can be prepared as described in U.S. Pat. No. 6,077,680 issued Jun. 20, 2000 to Kem et al., which is hereby incorporated by reference in its entirety. Other peptides of Table 2 can be prepared by techniques known in the art. For example, ShK(L5) (SEQ ID NO: 950) can be prepared as described in Beeton et al., Targeting effector memory T cells with a selective peptide inhibitor of Kv1.3 channels for therapy of autoimmune diseases, Molec. Pharmacol. 67(4): 1369-81 (2005), which is hereby incorporated by reference in its entirety. In Table 2 and throughout the specification, $X^{s15}$, $X^{s21}$, $X^{s22}$, $X^{s23}$ and $X^{s27}$ each independently refer to nonfunctional amino acid residues.

TABLE 3

HmK, BgK, AeK and AsKS peptide and peptide analog sequences

| Sequence/structure | Short-hand designation | SEQ ID NO: |
|---|---|---|
| RTCKDLIPVSECTDIRCRTSMKYRLNLCRKTCGSC | HmK | 6 |
| ATCKDLIPVSECTDIRCRTSMKYRLNLCRKTCGSC | HmK-A1 | 201 |
| STCKDLIPVSECTDIRCRTSMKYRLNLCRKTCGSC | HmK-S1 | 202 |
| TCKDLIPVSECTDIRCRTSMKYRLNLCRKTCGSC | HmK-d1 | 203 |
| SCKDLIPVSECTDIRCRTSMKYRLNLCRKTCGSC | HmK-d1/S2 | 204 |
| TCIDLIPVSECTDIRCRTSMKYRLNLCRKTCGSC | HmK-d1/I4 | 205 |
| TCKDTIPVSECTDIRCRTSMKYRLNLCRKTCGSC | HmK-d1/T6 | 206 |
| TCKDLIPKSECTDIRCRTSMKYRLNLCRKTCGSC | HmK-d1/K9 | 207 |
| TCKDLIPVSRCTDIRCRTSMKYRLNLCRKTCGSC | HmK-d1/R11 | 208 |
| TCKDLIPVSECTAIRCRTSMKYRLNLCRKTCGSC | HmK-d1/A14 | 209 |
| TCKDLIPVSECTDFRCRTSMKYRLNLCRKTCGSC | HmK-d1/F15 | 210 |
| TCKDLIPVSECTDIQCRTSMKYRLNLCRKTCGSC | HmK-d1/Q16 | 211 |
| TCKDLIPVSECTDIRCKTSMKYRLNLCRKTCGSC | HmK-d1/K18 | 212 |
| TCKDLIPVSECTDIRCRHSMKYRLNLCRKTCGSC | HmK-d1/H19 | 213 |
| TCKDLIPVSECTDIRCRTSMKYRLSLCRKTCGSC | HmK-d1/S26 | 214 |
| TCKDLIPVSECTDIRCRTSMKYRLNFCRKTCGSC | HmK-d1/F27 | 215 |
| TCKDLIPVSECTDIRCRTSMKYRLNLCRKTCGTC | HmK-d1/T34 | 216 |
| TCKDLIPVSRCTDIRCRTSMKYRLNFCRKTCGSC | HmK-d1/R11/F27 | 217 |

TABLE 3-continued

HmK, BgK, AeK and AsKS peptide and peptide analog sequences

| Sequence/structure | Short-hand designation | SEQ ID NO: |
|---|---|---|
| ATCKDLIPVSRCTDIRCRTSMKYRLNFCRKTCGSC | HmK-A1/R11/F27 | 218 |
| TCIDTIPKSRCTAFQCKHSMKYRLSFCRKTCGSC | HmK-d1/Z1 | 219 |
| TCIDTIPKSRCTAFQCRTSMKYRLNFCRKTCGSC | HmK-d1/Z2 | 220 |
| TCADLIPASRCTAIACRTSMKYRLNFCRKTCGSC | HmK-d1/Z3 | 221 |
| TCADLIPASRCTAIACKHSMKYRLNFCRKTCGSC | HmK-d1/Z4 | 222 |
| TCADLIPASRCTAIACAHSMKYRLNFCRKTCGSC | HmK-d1/Z5 | 223 |
| RTCKDLIPVSECTDIRCRTSMX$^{h22}$YRLNLCRKTCGSC | HmK-X22 | 224 |
| ATCKDLX$^{h6}$PVSRCTDIRCRTSMKX$^{h22}$RLNX$^{h26}$CRKTCGSC | HmK-X6, 22, 26 | 225 |
| VCRDWFKETACRHAKSLGNCRTSQKYRANCAKTCELC | BgK | 9 |
| ACRDWFKETACRHAKSLGNCRTSQKYRANCAKTCELC | BgK-A1 | 226 |
| VCADWFKETACRHAKSLGNCRTSQKYRANCAKTCELC | BgK-A3 | 227 |
| VCRDAFKETACRHAKSLGNCRTSQKYRANCAKTCELC | BgK-A5 | 228 |
| VCRDWFKATACRHAKSLGNCRTSQKYRANCAKTCELC | BgK-A8 | 229 |
| VCRDWFKEAACRHAKSLGNCRTSQKYRANCAKTCELC | BgK-A9 | 230 |
| VCRDWFKETACAHAKSLGNCRTSQKYRANCAKTCELC | BgK-A12 | 231 |
| VCRDWFKETACRHAASLGNCRTSQKYRANCAKTCELC | BgK-A15 | 232 |
| VCRDWFKETACRHAKALGNCRTSQKYRANCAKTCELC | BgK-A16 | 233 |
| VCRDWFKETACRHAKSAGNCRTSQKYRANCAKTCELC | BgK-A17 | 234 |
| VCRDWFKETACRHAKSLGNCATSQKYRANCAKTCELC | BgK-A21 | 235 |
| VCRDWFKETACRHAKSLGNCRASQKYRANCAKTCELC | BgK-A22 | 236 |
| VCRDWFKETACRHAKSLGNCRTSQKYAANCAKTCELC | BgK-A27 | 237 |
| VCRDWFKETACRHAKSLGNCRTSQKYRANCAATCELC | BgK-A32 | 238 |
| VCRDWFKETACRHAKSLGNCRTSQKYRANCAKACELC | BgK-A33 | 239 |
| VCRDWFKETACRHAKSLGNCRTSQKYRANCAKTCALC | BgK-A35 | 240 |
| VCRDWFKETACRHAKSLGNCRTSQKYRANCAKTCEAC | BgK-A37 | 241 |
| GCKDNFSANTCKHVKANNNCGSQKYATNCAKTCGKC | AeK | 7 |
| ACKDNFAAATCKHVKENKNCGSQKYATNCAKTCGKC | AsKS | 8 |

In Table 3 and throughout the specification, X$^{h6}$, X$^{h22}$, X$^{h26}$ are each independently nonfunctional residues.

TABLE 4

MgTx peptide and MgTx peptide analog sequences

| Sequence/structure | Short-hand designation | SEQ ID NO: |
|---|---|---|
| TIINVKCTSPKQCLPPCKAQFGQSAGAKCMNGKCKCYPH | MgTx | 28 |
| TIINVACTSPKQCLPPCKAQFGQSAGAKCMNGKCKCYPH | MgTx-A6 | 242 |
| TIINVSCTSPKQCLPPCKAQFGQSAGAKCMNGKCKCYPH | MgTx-S6 | 243 |

TABLE 4-continued

| MgTx peptide and MgTx peptide analog sequences | | |
|---|---|---|
| Sequence/structure | Short-hand designation | SEQ ID NO: |
| TIINVKCTSPAQCLPPCKAQFGQSAGAKCMNGKCKCYPH | MgTx-A11 | 244 |
| TIINVKCTSPKQCLPPCAAQFGQSAGAKCMNGKCKCYPH | MgTx-A18 | 245 |
| TIINVKCTSPKQCLPPCKAQFGQSAGAACMNGKCKCYPH | MgTx-A28 | 246 |
| TIINVKCTSPKQCLPPCKAQFGQSAGAKCMNGACKCYPH | MgTx-A33 | 247 |
| TIINVKCTSPKQCLPPCKAQFGQSAGAKCMNGKCACYPH | MgTx-A35 | 248 |
| TIINVKCTSPKQCLPPCKAQFGQSAGAKCMNGKCKCYPN | MgTx-H39N | 249 |
| TIINVACTSPKQCLPPCKAQFGQSAGAKCMNGKCKCYPN | MgTx-A6/H39N | 250 |
| TIINVSCTSPKQCLPPCKAQFGQSAGAKCMNGKCKCYS | MgTx-S6/38/d39 | 251 |
| TIITISCTSPKQCLPPCKAQFGQSAGAKCMNGKCKCYPH | MgTx-T4/I5/S6 | 252 |
| TISCTSPKQCLPPCKAQFGQSAGAKCMNGKCKCYPH | MgTx-d3/T4/I5/S6 | 253 |
| TISCTSPKQCLPPCKAQFGQSAGAKCMNGKCKCFGR | MgTx-Pi2 | 254 |
| NVACTSPKQCLPPCKAQFGQSAGAKCMNGKCKCYPH | MgTx-d3/A6 | 255 |
| QFTNVSCTSPKQCLPPCKAQFGQSAGAKCMNGKCKCYS | MgTx-ChTx | 256 |
| QFTDVDCTSPKQCLPPCKAQFGQSAGAKCMNGKCKCYQ | MgTx-IbTx | 257 |
| IINVSCTSPKQCLPPCKAQFGQSAGAKCMNGKCKCYPH | MgTx-Z1 | 258 |
| IITISCTSPKQCLPPCKAQFGQSAGAKCMNGKCKCYPH | MgTx-Z2 | 259 |
| GVIINVSCTSPKQCLPPCKAQFGQSAGAKCMNGKCKCYPH | MgTx-Z3 | 260 |

Many peptides as described in Table 4 can be prepared as described in WO 95/03065, published Feb. 2, 1995, for which the applicant is Merck & Co., Inc. That application corresponds to U.S. Ser. No. 07/096,942, filed 22 Jul. 1993, which is hereby incorporated by reference in its entirety.

TABLE 5

| AgTx2 peptide and AgTx2 peptide analog sequences | | |
|---|---|---|
| Sequence/structure | Short-hand designation | SEQ ID NO: |
| GVPINVSCTGSPQCIKPCKDAGMRFGKCMNRKCHCTPK | AgTx2 | 23 |
| GVPIAVSCTGSPQCIKPCKDAGMRFGKCMNRKCHCTPK | AgTx2-A5 | 261 |
| GVPINVSCTGSPQCIAPCKDAGMRFGKCMNRKCHCTPK | AgTx2-A16 | 262 |
| GVPINVSCTGSPQCIKPCADAGMRFGKCMNRKCHCTPK | AgTx2-A19 | 263 |
| GVPINVSCTGSPQCIKPCKDAGMAFGKCMNRKCHCTPK | AgTx2-A24 | 264 |
| GVPINVSCTGSPQCIKPCKDAGMRFGACMNRKCHCTPK | AgTx2-A27 | 265 |
| GVPINVSCTGSPQCIKPCKDAGMRFGKCMNAKCHCTPK | AgTx2-A31 | 266 |
| GVPINVSCTGSPQCIKPCKDAGMRFGKCMNRACHCTPK | AgTx2-A32 | 267 |
| GVPINVSCTGSPQCIKPCKDAGMRFGKCMNRKCHCTPA | AgTx2-A38 | 268 |
| GVPIAVSCTGSPQCIKPCKDAGMRFGKCMNRKCHCTPA | Agx2-A5/A38 | 269 |

TABLE 5-continued

AgTx2 peptide and AgTx2 peptide analog sequences

| Sequence/structure | Short-hand designation | SEQ ID NO: |
|---|---|---|
| GVPINVSCTGSPQCTKPCKDAGMRFGKCMNGKCHCTPK | AgTx2-G31 | 270 |
| GVPIIVSCKGSRQCIKPCKDAGMRFGKCMNGKCHCTPK | AgTx2-OSK_z1 | 271 |
| GVPIIVSCKISRQCIKPCKDAGMRFGKCMNGKCHCTPK | AgTx2-OSK_z2 | 272 |
| GVPIIVKCKGSRQCIKPCKDAGMRFGKCMNGKCHCTPK | AgTx2-OSK_z3 | 273 |
| GVPIIVKCKISRQCIKPCKDAGMRFGKCMNGKCHCTPK | AgTx2-OSK_z4 | 274 |
| GVPIIVKCKISRQCIKPCKDAGMRFGKCMNGKCHCTPK | AgTx2-OSK_z5 | 275 |

TABLE 6

Heteromitrus spinnifer (HsTx1) peptide and HsTx1 peptide analog sequences

| Sequence/structure | Short-hand designation | SEQ ID NO: |
|---|---|---|
| ASCRTPKDCADPCRKETGCPYGKCMNRKCKCNRC | HsTx1 | 61 |
| ASCXTPKDCADPCRKETGCPYGKCMNRKCKCNRC | HsTx1-X4 | 276 |
| ASCATPKDCADPCRKETGCPYGKCMNRKCKCNRC | HsTx1-A4 | 277 |
| ASCRTPXDCADPCRKETGCPYGKCMNRKCKCNRC | HsTx1-X7 | 278 |
| ASCRTPADCADPCRKETGCPYGKCMNRKCKCNRC | HsTx1-A7 | 279 |
| ASCRTPKDCADPCXKETGCPYGKCMNRKCKCNRC | HsTx1-X14 | 280 |
| ASCRTPKDCADPCAKETGCPYGKCMNRKCKCNRC | HsTx1-A14 | 281 |
| ASCRTPKDCADPCRXETGCPYGKCMNRKCKCNRC | HsTx1-X15 | 282 |
| ASCRTPKDCADPCRAETGCPYGKCMNRKCKCNRC | HsTx1-A15 | 283 |
| ASCRTPKDCADPCRKETGCPYGXCMNRKCKCNRC | HsTx1-X23 | 284 |
| ASCRTPKDCADPCRKETGCPYGACMNRKCKCNRC | HsTx1-A23 | 285 |

TABLE 6-continued

Heteromitrus spinnifer (HsTx1) peptide and HsTx1 peptide analog sequences

| Sequence/structure | Short-hand designation | SEQ ID NO: |
|---|---|---|
| ASCRTPKDCADPCRKETGCPYGKCMNXKCKCNRC | HsTx1-X27 | 286 |
| ASCRTPKDCADPCRKETGCPYGKCMNAKCKCNRC | HsTx1-A27 | 287 |
| ASCRTPKDCADPCRKETGCPYGKCMNRXCKCNRC | HsTx1-X28 | 288 |
| ASCRTPKDCADPCRKETGCPYGKCMNRACKCNRC | HsTx1-A28 | 289 |
| ASCRTPKDCADPCRKETGCPYGKCMNRKCXCNRC | HsTx1-X30 | 290 |
| ASCRTPKDCADPCRKETGCPYGKCMNRKCACNRC | HsTx1-A30 | 291 |
| ASCRTPKDCADPCRKETGCPYGKCMNRKCKCNXC | HsTx1-X33 | 292 |
| ASCRTPKDCADPCRKETGCPYGKCMNRKCKCNAC | HsTx1-A33 | 293 |

Peptides as described in Table 5 can be prepared as described in U.S. Pat. No. 6,689,749, issued Feb. 10, 2004 to Lebrun et al., which is hereby incorporated by reference in its entirety.

TABLE 7

Orthochirus scrobiculosus (OSK1) peptide and OSK1 peptide analog sequences

| Sequence/structure | Short-hand designation | SEQ ID NO: |
|---|---|---|
| GVIINVKCKISRQCLEPCKKAGMRFGKCMNGKCHCTPK | OSK1 | 25 |
| GVIINVSCKISRQCLEPCKKAGMRFGKCMNGKCHCTPK | OSK1-S7 | 1303 |
| GVIINVKCKISRQCLKPCKKAGMRFGKCMNGKCHCTPK | OSK1-K16 | 294 |
| GVIINVKCKISRQCLEPCKDAGMRFGKCMNGKCHCTPK | OSK1-D20 | 295 |
| GVIINVKCKISRQCLKPCKDAGMRFGKCMNGKCHCTPK | OSK1-K16, D20 | 296 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVSCKISRQCLKPCKDAGMRFGKCMNGKCHCTPK | OSK1-S7, K16, D20 | 1308 |
| GVIINVKCKISPQCLKPCKDAGMRFGKCMNGKCHCTPK | OSK1-P12, K16, D20 | 297 |
| GVIINVKCKISRQCLKPCKDAGMRFGKCMNGKCHCYPK | OSK1-K16, D20, Y36 | 298 |
| Ac-GVIINVKCKISPQCLKPCKDAGMRFGKCMNGKCHCTPK | Ac-OSK1-P12, K16, D20 | 562 |
| GVIINVKCKISPQCLKPCKDAGMRFGKCMNGKCHCTPK-$NH_2$ | OSK1-P12, K16, D20-$NH_2$ | 563 |
| Ac-GVIINVKCKISPQCLKPCKDAGMRFGKCMNGKCHCTPK-$NH_2$ | Ac-OSK1-P12, K16, D20-$NH_2$ | 564 |
| GVIINVKCKISRQCLKPCKDAGMRFGKCMNGKCHCYPK-$NH_2$ | OSK1-K16, D20, Y36-$NH_2$ | 565 |
| Ac-GVIINVKCKISRQCLKPCKDAGMRFGKCMNGKCHCYPK | Ac-OSK1-K16, D20, Y36 | 566 |
| Ac-GVIINVKCKISRQCLKPCKDAGMRFGKCMNGKCHCYPK-$NH_2$ | Ac-OSK1-K16, D20, Y36-$NH_2$ | 567 |
| GVIINVKCKISRQCLKPCKKAGMRFGKCMNGKCHCTPK-$NH_2$ | OSK1-K16-$NH_2$ | 568 |
| Ac-GVIINVKCKISRQCLKPCKKAGMRFGKCMNGKCHCTPK | Ac-OSK1-K16 | 569 |
| Ac-GVIINVKCKISRQCLKPCKKAGMRFGKCMNGKCHCTPK-$NH_2$ | Ac-OSK1-K16-$NH_2$ | 570 |
| Ac-GVIINVKCKISRQCLEPCKDAGMRFGKCMNGKCHCTPK | Ac-OSK1-D20 | 571 |
| GVIINVKCKISRQCLEPCKDAGMRFGKCMNGKCHCTPK-$NH_2$ | OSK1-D20-$NH_2$ | 572 |
| Ac-GVIINVKCKISRQCLEPCKDAGMRFGKCMNGKCHCTPK-$NH_2$ | Ac-QSK1-D20-$NH_2$ | 573 |
| GVIINVKCKISRQCLEPCKKAGMRFGKCMNGKCHCTPK-$NH_2$ | OSK1-$NH_2$ | 574 |
| Ac-GVIINVKCKISRQCLEPCKKAGMRFGKCMNGKCHCTPK | Ac-OSK1 | 575 |
| Ac-GVIINVKCKISRQCLEPCKKAGMRFGKCMNGKCHCTPK-$NH_2$ | Ac-OSK1-$NH_2$ | 576 |
| GVIINVKCKISRQCLKPCKDAGMRFGKCMNGKCHCTPK-$NH_2$ | OSK1-K16, D20-$NH_2$ | 577 |
| Ac-GVIINVKCKISRQCLKPCKDAGMRFGKCMNGKCHCTPK | Ac-OSK1-K16, D20 | 578 |
| Ac-GVIINVKCKISRQCLKPCKDAGMRFGKCMNGKCHCTPK-$NH_2$ | Ac-OSK1-K16, D20-$NH_2$ | 579 |
| VIINVKCKISRQCLEPCKKAGMRFGKCMNGKCHCTPK | Δ1-OSK1 | 580 |
| Ac-VIINVKCKISRQCLEPCKKAGMRFGKCMNGKCHCTPK | Ac-Δ1-OSK1 | 581 |
| VIINVKCKISRQCLEPCKKAGMRFGKCMNGKCHCTPK-$NH_2$ | Δ1-OSK1-$NH_2$ | 582 |
| Ac-VIINVKCKISRQCLEPCKKAGMRFGKCMNGKCHCTPK-$NH_2$ | Ac-Δ1-OSK1-$NH_2$ | 583 |
| GVIINVKCKISRQCLEPCKKAGMRFGKCMNGKCACTPK | OSK1-A34 | 584 |
| Ac-GVIINVKCKISRQCLEPCKKAGMRFGKCMNGKCACTPK | Ac-OSK1-A34 | 585 |
| GVIINVKCKISRQCLEPCKKAGMRFGKCMNGKCACTPK-$NH_2$ | OSK1-A34-$NH_2$ | 586 |
| Ac-GVIINVKCKISRQCLEPCKKAGMRFGKCMNGKCACTPK-$NH_2$ | Ac-OSK1-A34-$NH_2$ | 587 |
| VIINVKCKISRQCLKPCKDAGMRFGKCMNGKCHCTPK | Δ1-OSK1-K16, D20 | 588 |
| Ac-VIINVKCKISRQCLKPCKDAGMRFGKCMNGKCHCTPK | Ac-Δ1-OSK1-K16, D20 | 589 |

TABLE 7-continued

Orthochirus scrobiculosus (OSK1) peptide and OSK1 peptide analog sequences

| Sequence/structure | Short-hand designation | SEQ ID NO: |
|---|---|---|
| VIINVKCKISRQCLKPCKDAGMRFGKCMNGKCHCTPK-$NH_2$ | Δ1-OSK1-K16, D20-$NH_2$ | 590 |
| Ac-VIINVKCKISRQCLKPCKDAGMRFGKCMNGKCHCTPK-$NH_2$ | Ac-Δ1-OSK1-K16, D20-$NH_2$ | 591 |
| NVKCKISRQCLKPCKDAGMRFGKCMNGKCHCTPK | (Δ1-4)-OSK1-K16, D20 | 592 |
| Ac-NVKCKISRQCLKPCKDAGMRFGKCMNGKCHCTPK | Ac-(Δ1-4)-OSK1-K16, D20 | 593 |
| NVKCKISRQCLKPCKDAGMRFGKCMNGKCHCTPK-$NH_2$ | (Δ1-4)-OSK1-K16, D20-$NH_2$ | 594 |
| Ac-NVKCKISRQCLKPCKDAGMRFGKCMNGKCHCTPK-$NH_2$ | Ac-(Δ1-4)-OSK1-K16, D20-$NH_2$ | 595 |
| KCKISRQCLKPCKDAGMRFGKCMNGKCHCTPK | (Δ1-6)-OSK1-K16, D20 | 596 |
| Ac-KCKISRQCLKPCKDAGMRFGKCMNGKCHCTPK | Ac-(Δ1-6)-OSK1-K16, D20 | 597 |
| KCKISRQCLKPCKDAGMRFGKCMNGKCHCTPK-$NH_2$ | (Δ1-6)-OSK1-K16, D20-$NH_2$ | 598 |
| Ac-KCKISRQCLKPCKDAGMRFGKCMNGKCHCTPK-$NH_2$ | Ac-(Δ1-6)-OSK1-K16, D20-$NH_2$ | 599 |
| CKISRQCLKPCKDAGMRFGKCMNGKCHCTPK | (Δ1-7)-OSK1-K16, D20 | 600 |
| Ac-CKISRQCLKPCKDAGMRFGKCMNGKCHCTPK | Ac-(Δ1-7)-OSK1-K16, D20 | 601 |
| CKISRQCLKPCKDAGMRFGKCMNGKCHCTPK-$NH_2$ | (Δ1-7)-OSK1-K16, D20-$NH_2$ | 602 |
| Ac-CKISRQCLKPCKDAGMRFGKCMNGKCHCTPK-$NH_2$ | Ac-(Δ1-7)-OSK1-K16, D20-$NH_2$ | 603 |
| GVIINVKCKISRQCLKPCKDAGMRNGKCMNGKCHCTPK | OSK1-K16, D20, N25 | 604 |
| GVIINVKCKISRQCLKPCKDAGMRNGKCMNGKCHCTPK-$NH_2$ | OSK1-K16, D20, N25-$NH_2$ | 605 |
| Ac-GVIINVKCKISRQCLKPCKDAGMRNGKCMNGKCHCTPK | Ac-OSK1-K16, D20, N25 | 606 |
| Ac-GVIINVKCKISRQCLKPCKDAGMRNGKCMNGKCHCTPK-$NH_2$ | Ac-OSK1-K16, D20, N25-$NH_2$ | 607 |
| GVIINVKCKISRQCLKPCKDAGMRFGKCMNRKCHCTPK | OSK1-K16, D20, R31 | 608 |
| GVIINVKCKISRQCLKPCKDAGMRFGKCMNRKCHCTPK-$NH_2$ | OSK1-K16, D20, R31-$NH_2$ | 609 |
| Ac-GVIINVKCKISRQCLKPCKDAGMRFGKCMNRKCHCTPK | Ac-OSK1-K16, D20, R31 | 610 |
| Ac-GVIINVKCKISRQCLKPCKDAGMRFGKCMNRKCHCTPK-$NH_2$ | Ac-OSK1-K16, D20, R31-$NH_2$ | 611 |
| GVIINVKCKISKQCLKPCRDAGMRFGKCMNGKCHCTPK | OSK1-K12, K16, R19, D20 | 612 |
| Ac-GVIINVKCKISKQCLKPCRDAGMRFGKCMNGKCHCTPK | Ac-OSK1-K12, K16, R19, D20 | 613 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISKQCLKPCRDAGMRFGKCMNGKCHCTPK-$NH_2$ | OSK1-K12, K16, R19, D20-$NH_2$ | 614 |
| Ac-GVIINVKCKISKQCLKPCRDAGMRFGKCMNGKCHCTPK-$NH_2$ | Ac-OSK1-K12, K16, R19, D20-$NH_2$ | 615 |
| TIINVKCKISRQCLKPCKDAGMRFGKCMNGKCHCTPK | Δ1-OSK1-T2, K16, D20 | 616 |
| Ac-TIINVKCKISRQCLKPCKDAGMRFGKCMNGKCHCTPK | Ac-Δ1-OSK1-T2, K16, D20 | 617 |
| TIINVKCKISRQCLKPCKDAGMRFGKCMNGKCHCTPK-$NH_2$ | Δ1-OSK1-T2, K16, D20-$NH_2$ | 618 |
| Ac-TIINVKCKISRQCLKPCKDAGMRFGKCMNGKCHCTPK-$NH_2$ | Ac-Δ1-OSK1-T2, K16, D20-$NH_2$ | 619 |
| GVKINVKCKISRQCLEPCKKAGMRFGKCMNGKCHCTPK | OSK1-K3 | 620 |
| Ac-GVKINVKCKISRQCLEPCKKAGMRFGKCMNGKCHCTPK | Ac-OSK1-K3 | 621 |
| GVKINVKCKISRQCLEPCKKAGMRFGKCMNGKCHCTPK-$NH_2$ | OSK1-K3-$NH_2$ | 622 |
| Ac-GVKINVKCKISRQCLEPCKKAGMRFGKCMNGKCHCTPK-$NH_2$ | AC-OSK1-K3-$NH_2$ | 623 |
| GVKINVKCKISRQCLEPCKKAGMRFGKCMNGKCACTPK | OSK1-K3, A34 | 624 |
| GVKINVKCKISRQCLKPCKDAGMRFGKCMNGKCHCTPK | OSK1-K3, K16, D20 | 625 |
| GVKINVKCKISRQCLKPCKDAGMRFGKCMNGKCACTPK | OSK1-K3, K16, D20, A34 | 626 |
| Ac-GVKINVKCKISRQCLEPCKKAGMRFGKCMNGKCACTPK | Ac-OSK1-K3, A34 | 627 |
| GVKINVKCKISRQCLEPCKKAGMRFGKCMNGKCACTPK-$NH_2$ | OSK1-K3, A34-$NH_2$ | 628 |
| Ac-GVKINVKCKISRQCLEPCKKAGMRFGKCMNGKCACTPK-$NH_2$ | Ac-OSK1-K3, A34-$NH_2$ | 629 |
| Ac-GVKINVKCKISRQCLKPCKDAGMRFGKCMNGKCACTPK | Ac-OSK1-K3, K16, D20, A34 | 630 |
| GVKINVKCKISRQCLKPCKDAGMRFGKCMNGKCACTPK-$NH_2$ | OSK1-K3, K16, D20, A34-$NH_2$ | 631 |
| Ac-GVKINVKCKISRQCLKPCKDAGMRFGKCMNGKCACTPK-$NH_2$ | Ac-OSK1-K3, K16, D20, A34-$NH_2$ | 632 |
| Ac-GVKINVKCKISRQCLKPCKDAGMRFGKCMNGKCHCTPK | Ac-OSK1-K3, K16, D20 | 633 |
| GVKINVKCKISRQCLKPCKDAGMRFGKCMNGKCHCTPK-$NH_2$ | OSK1-K3, K16, D20-$NH_2$ | 634 |
| Ac-GVKINVKCKISRQCLKPCKDAGMRFGKCMNGKCHCTPK-$NH_2$ | Ac-OSK1-K3, K16, D20-$NH_2$ | 635 |
| GVIINVKCKISRQCLKPCKDAGMRFGKCMNGKCHCT | Δ36-38-OSK1-K16, D20 | 636 |
| GVIINVKCKISRQCLOPCKDAGMRFGKCMNGKCHCTPK | OSK1-O16, D20 | 980 |
| GVIINVKCKISRQCL[hLys]PCKDAGMRFGKCMNGKCHCTPK | OSK1-hLys 16, D20 | 981 |
| GVIINVKCKISRQCL[hArg]PCKDAGMRFGKCMNGKCHCTPK | OSK1-hArg 16, D20 | 982 |
| GVIINVKCKISRQCL[Cit]PCKDAGMRFGKCMNGKCHCTPK | OSK1-Cit 16, D20 | 983 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hCit]PCKDAGMRFGKCMNGKCHCTPK | OSK1-hCit 16, D20 | 984 |
| GVIINVKCKISRQCL[Dpr]PCKDAGMRFGKCMNGKCHCTPK | OSK1-Dpr 16, D20 | 985 |
| GVIINVKCKISRQCL[Dab]PCKDAGMRFGKCMNGKCHCTPK | OSK1-Dab 16, D20 | 986 |
| GVIINVKCKISRQCLOPCKDAGMRFGKCMNGKCHCYPK | OSK1-O16, D20, Y36 | 987 |
| GVIINVKCKISRQCL[hLys]PCKDAGMRFGKCMNGKCHCYPK | OSK1-hLys 16, D20, Y36 | 988 |
| GVIINVKCKISRQCL[hArg]PCKDAGMRFGKCMNGKCHCYPK | OSK1-hArg 16, D20, Y36 | 989 |
| GVIINVKCKISRQCL[Cit]PCKDAGMRFGKCMNGKCHCYPK | OSK1-Cit 16, D20, Y36 | 990 |
| GVIINVKCKISRQCL[hCit]PCKDAGMRFGKCMNGKCHCYPK | OSK1-hCit 16, D20, Y36 | 991 |
| GVIINVKCKISRQCL[Dpr]PCKDAGMRFGKCMNGKCHCYPK | OSK1-Dpr 16, D20, Y36 | 992 |
| GVIINVKCKISRQCL[Dab]PCKDAGMRFGKCMNGKCHCYPK | OSK1-Dab 16, D20, Y36 | 993 |
| GVIINVKCKISRQCLKPCKDAGMRFGKCMNGKCACYPK | OSK1-K16, D20, A34, Y36 | 994 |
| GVIINVKCKISRQCLKPCKDAGMRFGKCMNGKCGCYPK | OSK1-K16, D20, G34, Y36 | 995 |
| GVIINVKCKISRQCLKPCKDAGMRFGKCMNGKCACFPK | OSK1-K16, D20, A34, F36 | 996 |
| GVIINVKCKISRQCLKPCKDAGMRFGKCMNGKCACWPK | OSK1-K16, D20, A34, W36 | 997 |
| GVIINVKCKISRQCLKPCKEAGMRFGKCMNGKCACYPK | OSK1-K16, E20, A34, Y36 | 998 |
| GVIINVKCKISRQCLOPCKDAGMRFGKCMNGKCACTPK | OSK1-O16, D20, A34 | 999 |
| GVIINVKCKISRQCL[hLys]PCKDAGMRFGKCMNGKCACTPK | OSK1-hLys 16, D20, A34 | 1000 |
| GVIINVKCKISRQCL[hArg]PCKDAGMRFGKCMNGKCACTPK | OSK1-hArg 16, D20, A34 | 1001 |
| GVIINVKCKISRQCL[Cit]PCKDAGMRFGKCMNGKCACTPK | OSK1-Cit 16, D20, A34 | 1002 |
| GVIINVKCKISRQCL[hCit]PCKDAGMRFGKCMNGKCHCTPK | OSK1-hCit 16, D20, A34 | 1003 |
| GVIINVKCKISRQCL[Dpr]PCKDAGMRFGKCMNGKCACTPK | OSK1-Dpr 16, D20, A34 | 1004 |
| GVIINVKCKISRQCL[Dab]PCKDAGMRFGKCMNGKCACTPK | OSK1-Dab 16, D20, A34 | 1005 |
| GVIINVKCKISRQCLOPCKDAGMRFGKCMNGKCHC | Δ36-38, OSK1-O16, D20, | 1006 |
| GVIINVKCKISRQCL[hLys]PCKDAGMRFGKCMNGKCHC | Δ36-38, OSK1-hLys 16, D20 | 1007 |
| GVIINVKCKISRQCL[hArg]PCKDAGMRFGKCMNGKCHC | Δ36-38, OSK1-hArg 16, D20 | 1008 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKDAGMRFGKCMNGKCHC | Δ36-38, OSK1-Cit 16, D20 | 1009 |
| GVIINVKCKISRQCL[hCit]PCKDAGMRFGKCMNGKCHC | Δ36-38, OSK1-hCit 16, D20 | 1010 |
| GVIINVKCKISRQCL[Dpr]PCKDAGMRFGKCMNGKCHC | Δ36-38, OSK1-Dpr 16, D20 | 1011 |
| GVIINVKCKISRQCL[Dab]PCKDAGMRFGKCMNGKCHC | Δ36-38, OSK1-Dab16, D20 | 1012 |
| GVIINVKCKISRQCLOPCKDAGMRFGKCMNGKCAC | Δ36-38, OSK1-O16, D20, A34 | 1013 |
| GVIINVKCKISRQCL[hLys]PCKDAGMRFGKCMNGKCAC | Δ36-38, OSK1-hLys 16, D20, A34 | 1014 |
| GVIINVKCKISRQCL[hArg]PCKDAGMRFGKCMNGKCAC | Δ36-38, OSK1-hArg 16, D20, A34 | 1015 |
| GVIINVKCKISRQCL[Cit]PCKDAGMRFGKCMNGKCAC | Δ36-38, OSK1-cit 16, D20, A34 | 1016 |
| GVIINVKCKISRQCL[hCit]PCKDAGMRFGKCMNGKCHC | Δ36-38, OSK1-hCit 16, D20, A34 | 1017 |
| GVIINVKCKISRQCL[Dpr]PCKDAGMRFGKCMNGKCAC | Δ36-38, OSK1-Dpr 16, D20, A34 | 1018 |
| GVIINVKCKISRQCL[Dab]PCKDAGMRFGKCMNGKCAC | Δ36-38, OSK1-Dab 16, D20, A34 | 1019 |
| GVIINVKCKISRQCLKPCKDAGMRFGKCMNGKCGCYGG | OSK1-K16, D20, G34, Y36, G37, G38 | 1020 |
| GVIINVKCKISRQCLOPCKDAGMRFGKCMNGKCHCYGG | OSK1-O16, D20, Y36, G37, G38 | 1021 |
| GVIINVKCKISRQCL[hLys]PCKDAGMRFGKCMNGKCHCYGG | OSK1-hLys 16, D20, Y36, G37, G38 | 1022 |
| GVIINVKCKISRQCL[hArg]PCKDAGMRFGKCMNGKCHCYGG | OSK1-hArg 16, D20, Y36, G37, G38 | 1023 |
| GVIINVKCKISRQCL[Cit]PCKDAGMRFGKCMNGKCHCYGG | OSK1-Cit 16, D20, Y36, G37, G38 | 1024 |
| GVIINVKCKISRQCL[hCit]PCKDAGMRFGKCMNGKCHCYGG | OSK1-hCit 16, D20, Y36, G37, G38 | 1025 |
| GVIINVKCKISRQCL[Dpr]PCKDAGMRFGKCMNGKCHCYGG | OSK1-Dpr 16, D20, Y36, G37, G38 | 1026 |
| GVIINVKCKISRQCLKPCKDAGMRFGKCMNGKCACYGG | OSK1-K16, D20, A34, Y36, G37, G38 | 1027 |
| GVIINVKCKISRQCLOPCKDAGMRFGKCMNGKCACYGG | OSK1-O16, D20, A34, Y36, G37, G38 | 1028 |
| GVIINVKCKISRQCL[hLys]PCKDAGMRFGKCMNGKCACYGG | OSK1-hLys 16, D20, A34, Y36, G37, G38 | 1029 |
| GVIINVKCKISRQCL[hArg]PCKDAGMRFGKCMNGKCACYGG | OSK1-hArg 16, D20, A34, Y36, G37, G38 | 1030 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKDAGMRFGKCMNGKCACYGG | OSK1-Cit 16, D20, A34, Y36, G37, G38 | 1031 |
| GVIINVKCKISRQCL[hCit]PCKDAGMRFGKCMNGKCHCYGG | OSK1-hCit 16, D20, A34, Y3, G37, G38 | 1032 |
| GVIINVKCKISRQCL[Dpr]PCKDAGMRFGKCMNGKCACYGG | OSK1-Dpr 16, D20, A34, Y36, G37, G38 | 1033 |
| GVIINVKCKISRQCL[Dab]PCKDAGMRFGKCMNGKCACYGG | OSK1-Dab 16, D20, A34, Y36, G37, G38 | 1034 |
| GVIINVKCKISRQCLKPCKDAGMRFGKCMNGKCACYG | Δ38, OSK1-K16, D20, A34, Y36, G37 | 1035 |
| GVIINVKCKISRQCLOPCKDAGMRFGKCMNGKCHCGGG | OSK1-O16, D20, G36-38 | 1036 |
| GVIINVKCKISRQCL[hLys]PCKDAGMRFGKCMNGKCHCGGG | OSK1-hLys 16, D20, G36-38 | 1037 |
| GVIINVKCKISRQCL[hArg]PCKDAGMRFGKCMNGKCHCGGG | OSK1-hArg 16, D20, G36-38 | 1038 |
| GVIINVKCKISRQCL[Cit]PCKDAGMRFGKCMNGKCHCGGG | OSK1-Cit 16, D20, G36-38 | 1039 |
| GVIINVKCKISRQCL[hCit]PCKDAGMRFGKCMNGKCHCGGG | OSK1-hCit 16, D20, G36-38 | 1040 |
| GVIINVKCKISRQCL[Dpr]PCKDAGMRFGKCMNGKCHCGGG | OSK1-Dpr 16, D20, G36-38 | 1041 |
| GVIINVKCKISRQCLKPCKDAGMRFGKCMNGKCACFGG | OSK1-K16, D20, A34, F36, G37, G38 | 1042 |
| GVIINVKCKISRQCLOPCKDAGMRFGKCMNGKCACGGG | OSK1-O16, D20, A34, G36-38 | 1043 |
| GVIINVKCKISRQCL[hLys]PCKDAGMRFGKCMNGKCACGGG | OSK1-hLys 16, D20, A34, G36-38 | 1044 |
| GVIINVKCKISRQCL[hArg]PCKDAGMRFGKCMNGKCACGGG | OSK1-hArg 16, D20, A34, G36-38 | 1045 |
| GVIINVKCKISRQCL[Cit]PCKDAGMRFGKCMNGKCACGGG | OSK1-Cit 16, D20, A34, G36-38 | 1046 |
| GVIINVKCKISRQCL[hCit]PCKDAGMRFGKCMNGKCACGGG | OSK1-hCit 16, D20, A34, G36-38 | 1047 |
| GVIINVKCKISRQCL[Dpr]PCKDAGMRFGKCMNGKCACGGG | OSK1-Dpr 16, D20, A34, G36-38 | 1048 |
| GVIINVKCKISRQCL[Dab]PCKDAGMRFGKCMNGKCACGGG | OSK1-Dab 16, D20, A34, G36-38 | 1049 |
| GVIINVKCKISRQCLKPCKDAGMRFGKCMNGKCACGG | Δ38, OSK1-K16, D20, A34, G36-37 | 1050 |
| GVIINVKCKISRQCLKPCKDAGMRFGKCMNGKCACYG | Δ38, OSK1-K16, D20, A35, Y36, G37 | 1051 |

TABLE 7-continued

| Orthochirus scrobiculosus (OSK1) peptide and OSK1 peptide analog sequences | | |
|---|---|---|
| Sequence/structure | Short-hand designation | SEQ ID NO: |
| GVIINVKCKISRQCLOPCKDAGMRFGKCMNGKCACGG | Δ38, OSK1-O16, D20, A35, Y36, G37 | 1052 |
| GVIINVKCKISRQCL[hLys]PCKEAGMRFGKCMNGKCHCTPK | OSK1-hLys 16, E20 | 1053 |
| GVIINVKCKISRQCL[hArg]PCKEAGMRFGKCMNGKCHCTPK | OSK1-hArg 16, E20 | 1054 |
| GVIINVKCKISRQCL[Cit]PCKEAGMRFGKCMNGKCHCTPK | OSK1-Cit 16, E20 | 1055 |
| GVIINVKCKISRQCL[hCit]PCKEAGMRFGKCMNGKCHCTPK | OSK1-hCit 16, E20 | 1056 |
| GVIINVKCKISRQCL[Dpr]PCKEAGMRFGKCMNGKCHCTPK | OSK1-Dpr 16, E20 | 1057 |
| GVIINVKCKISRQCL[Dab]PCKEAGMRFGKCMNGKCHCTPK | OSK1-Dab 16, E20 | 1058 |
| GVIINVKCKISRQCLOPCKEAGMRFGKCMNGKCHCYPK | OSK1-O16, E20, Y36 | 1059 |
| GVIINVKCKISRQCL[hLys]PCKEAGMRFGKCMNGKCHCYPK | OSK1-hLys 16, E20, Y36 | 1060 |
| GVIINVKCKISRQCL[hArg]PCKEAGMRFGKCMNGKCHCYPK | OSK1-hArg 16, E20, Y36 | 1061 |
| GVIINVKCKISRQCL[Cit]PCKEAGMRFGKCMNGKCHCYPK | OSK1-Cit 16, E20, Y36 | 1062 |
| GVIINVKCKISRQCL[hCit]PCKEAGMRFGKCMNGKCHCYPK | OSK1-hCit 16, E20, Y36 | 1063 |
| GVIINVKCKISRQCL[Dpr]PCKEAGMRFGKCMNGKCHCYPK | OSK1-Dpr 16, E20, Y36 | 1064 |
| GVIINVKCKISRQCL[Dab]PCKEAGMRFGKCMNGKCHCYPK | OSK1-Dab 16, E20, Y36 | 1065 |
| GVIINVKCKISRQCLOPCKEAGMRFGKCMNGKCACTPK | OSK1-O16, E20, A34 | 1066 |
| GVIINVKCKISRQCL[hLys]PCKEAGMRFGKCMNGKCACTPK | OSK1-hLys 16, E20, A34 | 1067 |
| GVIINVKCKISRQCL[hArg]PCKEAGMRFGKCMNGKCACTPK | OSK1-hArg 16, E20, A34 | 1068 |
| GVIINVKCKISRQCL[Cit]PCKEAGMRFGKCMNGKCACTPK | OSK1-Cit 16, E20, A34 | 1069 |
| GVIINVKCKISRQCL[hCit]PCKEAGMRFGKCMNGKCHCTPK | OSK1-hCit 16, E20, A34 | 1070 |
| GVIINVKCKISRQCL[Dpr]PCKEAGMRFGKCMNGKCACTPK | OSK1-Dpr 16, E20, A34 | 1071 |
| GVIINVKCKISRQCL[Dab]PCKEAGMRFGKCMNGKCACTPK | OSK1-Dab 16, E20, A34 | 1072 |
| GVIINVKCKISRQCLOPCKEAGMRFGKCMNGKCHC | Δ36-38, OSK1-O16, E20, | 1073 |
| GVIINVKCKISRQCL[hLys]PCKEAGMRFGKCMNGKCHC | Δ36-38, OSK1-hLys 16, E20 | 1074 |
| GVIINVKCKISRQCL[hArg]PCKEAGMRFGKCMNGKCHC | Δ36-38, OSK1-hArg 16, E20 | 1075 |
| GVIINVKCKISRQCL[Cit]PCKEAGMRFGKCMNGKCHC | Δ36-38, OSK1-Cit 16, E20 | 1076 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hCit]PCKEAGMRFGKCMNGKCHC | Δ36-38, OSK1-hCit16, E20 | 1077 |
| GVIINVKCKISRQCL[Dpr]PCKEAGMRFGKCMNGKCHC | Δ36-38, OSK1-Dpr 16, E20 | 1078 |
| GVIINVKCKISRQCLOPCKEAGMRFGKCMNGKCAC | Δ36-38, OSK1-O16, E20, A34 | 1079 |
| GVIINVKCKISRQCL[hLys]PCKEAGMRFGKCMNGKCAC | Δ36-38, OSK1-hLys 16, E20, A34 | 1080 |
| GVIINVKCKISRQCL[hArg]PCKEAGMRFGKCMNGKCAC | Δ36-38, OSK1-hArg 16, E20, A34 | 1081 |
| GVIINVKCKISRQCL[Cit]PCKEAGMRFGKCMNGKCAC | Δ36-38, OSK1-Cit 16, E20, A34 | 1082 |
| GVIINVKCKISRQCL[hCit]PCKEAGMRFGKCMNGKCHC | Δ36-38, OSK1-hCit 16, E20, A34 | 1083 |
| GVIINVKCKISRQCL[Dpr]PCKEAGMRFGKCMNGKCAC | Δ36-38, OSK1-Dpr 16, E20, A34 | 1084 |
| GVIINVKCKISRQCL[Dab]PCKEAGMRFGKCMNGKCAC | Δ36-38, OSK1-Dab 16, E20, A34 | 1085 |
| GVIINVKCKISRQCLKPCKEAGMRFGKCMNGKCHCYGG | OSK1-K16, E20, Y36, G37, G38 | 1086 |
| GVIINVKCKISRQCLOPCKEAGMRFGKCMNGKCHCYGG | OSK1-O16, E20, Y36, G37, G38 | 1087 |
| GVIINVKCKISRQCLKPCKEAGMRFGKCMNGKCHCYG | Δ38 OSK1-K16, E20, Y36, G37 | 1088 |
| GVIINVKCKISRQCLKPCKEAGMRFGKCMNGKCACYG | Δ38 OSK1-K16, E20, A34, Y36, G37 | 1089 |
| GVIINVKCKISRQCL[hLys]PCKEAGMRFGKCMNGKCHCYGG | OSK1-hLys 16, E20, Y36, G37, G38 | 1090 |
| GVIINVKCKISRQCL[hArg]PCKEAGMRFGKCMNGKCHCYGG | OSK1-hArg 16, E20, Y36, G37, G38 | 1091 |
| GVIINVKCKISRQCL[Cit]PCKEAGMRFGKCMNGKCHCYGG | OSK1-Cit 16, E20, Y36, G37, G38 | 1092 |
| GVIINVKCKISRQCL[hCit]PCKEAGMRFGKCMNGKCHCYGG | Δ37-38, OSK1-hCit 16, E20, Y36, G37, G38 | 1093 |
| GVIINVKCKISRQCL[Dpr]PCKEAGMRFGKCMNGKCHCYGG | OSK1-Dpr 16, E20, Y36, G37, G38 | 1094 |
| GVIINVKCKISRQCL[Dab]PCKEAGMRFGKCMNGKCHCYGG | OSK1-Dab 16, E20, Y36, G37, G38 | 1095 |
| GVIINVKCKISRQCLKPCKEAGMRFGKCMNGKCACYG | Δ38, OSK1-K16, E20, A34, Y36, G37 | 1096 |
| GVIINVKCKISRQCLOPCKEAGMRFGKCMNGKCACYGG | OSK1-O16, E20, A34, Y36, G37, G38 | 1097 |
| GVIINVKCKISRQCL[hLys]PCKEAGMRFGKCMNGKCACYGG | OSK1-hLys 16, E20, A34, Y36, G37, G38 | 1098 |

TABLE 7-continued

| Orthochirus scrobiculosus (OSK1) peptide and OSK1 peptide analog sequences | | |
|---|---|---|
| Sequence/structure | Short-hand designation | SEQ ID NO: |
| GVIINVKCKISRQCL[hArg]PCKEAGMRFGKCMNGKCACYGG | OSK1-hArg 16, E20, A34, Y36, G37, G38 | 1099 |
| GVIINVKCKISRQCL[Cit]PCKEAGMRFGKCMNGKCACYGG | OSK1-Cit 16, E20, A34, Y36, G37, G38 | 1100 |
| GVIINVKCKISRQCL[hCit]PCKEAGMRFGKCMNGKCHCYGG | OSK1-hCit 16, E20, A34, Y3, G37, G38 | 1101 |
| GVIINVKCKISRQCL[Dpr]PCKEAGMRFGKCMNGKCACYGG | OSK1-Dpr 16, E20, A34, Y36, G37, G38 | 1102 |
| GVIINVKCKISRQCL[Dab]PCKEAGMRFGKCMNGKCACYGG | OSK1-Dab 16, E20, A34, Y36, G37, G38 | 1103 |
| GVIINVKCKISRQCLKPCKEAGMRFGKCMNGKCACFGG | OSK1- K16, D20, A34, F36, G37, G38 | 1104 |
| GVIINVKCKISRQCLOPCKEAGMRFGKCMNGKCHCGGG | OSK1- O16, E20, G36-38 | 1105 |
| GVIINVKCKISRQCL[hLys]PCKEAGMRFGKCMNGKCHCGGG | OSK1-hLys 16, E20, G36-38 | 1106 |
| GVIINVKCKISRQCL[hArg]PCKEAGMRFGKCMNGKCHCGGG | OSK1-hArg 16, E20, G36-38 | 1107 |
| GVIINVKCKISRQCL[Cit]PCKEAGMRFGKCMNGKCHCGGG | OSK1-Cit 16, E20, G36-38 | 1108 |
| GVIINVKCKISRQCL[hCit]PCKEAGMRFGKCMNGKCHCGGG | OSK1-hCit 16, E20, G36-38 | 1109 |
| GVIINVKCKISRQCL[Dpr]PCKEAGMRFGKCMNGKCHCGGG | OSK1-Dpr 16, E20, G36-38 | 1110 |
| GVIINVKCKISRQCLOPCKEAGMRFGKCMNGKCACGGG | OSK1- O16, E20, A34, G36-38 | 1111 |
| GVIINVKCKISRQCL[hLys]PCKEAGMRFGKCMNGKCACGGG | OSK1-hLys 16, E20, A34, G36-38 | 1112 |
| GVIINVKCKISRQCL[hArg]PCKEAGMRFGKCMNGKCACGGG | OSK1-hArg 16, E20, A34, G36-38 | 1113 |
| GVIINVKCKISRQCL[Cit]PCKEAGMRFGKCMNGKCACGGG | OSK1-Cit 16, E20, A34, G36-38 | 1114 |
| GVIINVKCKISRQCL[hCit]PCKEAGMRFGKCMNGKCACTP | OSK1-hCit 16, E20, A34, G36-38 | 1115 |
| GVIINVKCKISRQCL[Dpr]PCKEAGMRFGKCMNGKCACTP | OSK1-Dpr 16, E20, A34, G36-38 | 1116 |
| GVIINVKCKISRQCL[Dab]PCKEAGMRFGKCMNGKCACTP | OSK1-Dab 16, E20, A34, G36-38 | 1117 |
| GVIINVKCKISRQCLOPCKDAGMRFGKCMNGKCHCTPK-NH2 | OSK1-O16, D20-amide | 1118 |
| GVIINVKCKISRQCL[hLys]PCKDAGMRFGKCMNGKCHCTPK-NH2 | OSK1-hLys 16, D20-amide | 1119 |
| GVIINVKCKISRQCL[hArg]PCKDAGMRFGKCMNGKCHCTPK-NH2 | OSK1-hArg 16, D20-amide | 1120 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[Cit]PCKDAGMRFGKCMNGKCHCTPK-NH2 | OSK1-Cit 16, D20-amide | 1121 |
| GVIINVKCKISRQCL[hCit]PCKDAGMRFGKCMNGKCHCTPK-NH2 | OSK1-hCit 16, D20-amide | 1122 |
| GVIINVKCKISRQCL[Dpr]PCKDAGMRFGKCMNGKCHCTPK-NH2 | OSK1-Dpr 16, D20-amide | 1123 |
| GVIINVKCKISRQCL[Dab]PCKDAGMRFGKCMNGKCHCTPK-NH2 | OSK1-Dab 16, D20 | 1124 |
| GVIINVKCKISRQCLOPCKDAGMRFGKCMNGKCHCYPK-NH2 | OSK1-O16, D20, Y36-amide | 1125 |
| GVIINVKCKISRQCL[hLys]PCKDAGMRFGKCMNGKCHCYPK-NH2 | OSK1-hLys 16, D20, Y36-amide | 1126 |
| GVIINVKCKISRQCL[hArg]PCKDAGMRFGKCMNGKCHCYPK-NH2 | OSK1-hArg 16, D20, Y36-amide | 1127 |
| GVIINVKCKISRQCL[Cit]PCKDAGMRFGKCMNGKCHCYPK-NH2 | OSK1-Cit 16, D20, Y36-amide | 1128 |
| GVIINVKCKISRQCL[hCit]PCKDAGMRFGKCMNGKCHCYPK-NH2 | OSK1-hCit 16, D20, Y36-amide | 1129 |
| GVIINVKCKISRQCL[Dpr]PCKDAGMRFGKCMNGKCHCYPK-NH2 | OSK1-Dpr 16, D20, Y36-amide | 1130 |
| GVIINVKCKISRQCL[Dab]PCKDAGMRFGKCMNGKCHCYPK-NH2 | OSK1-Dab 16, D20, Y36-amide | 1131 |
| GVIINVKCKISRQCLOPCKDAGMRFGKCMNGKCACTPK-NH2 | OSK1-O16, D20, A34-amide | 1132 |
| GVIINVKCKISRQCL[hLys]PCKDAGMRFGKCMNGKCACTPK-NH2 | OSK1-hLys 16, D20, A34-amide | 1133 |
| GVIINVKCKISRQCL[hArg]PCKDAGMRFGKCMNGKCACTPK-NH2 | OSK1-hArg 16, D20, A34-amide | 1134 |
| GVIINVKCKISRQCL[Cit]PCKDAGMRFGKCMNGKCACTPK-NH2 | OSK1-Cit 16, D20, A34-amide | 1135 |
| GVIINVKCKISRQCL[hCit]PCKDAGMRFGKCMNGKCACTPK-NH2 | OSK1-hCit 16, D20, A34-amide | 1136 |
| GVIINVKCKISRQCL[Dpr]PCKDAGMRFGKCMNGKCACTPK-NH2 | OSK1-Dpr 16, D20, A34-amide | 1137 |
| GVIINVKCKISRQCL[Dab]PCKDAGMRFGKCMNGKCACTPK-NH2 | OSK1-Dab 16, D20, A34-amide | 1138 |
| GVIINVKCKISRQCLOPCKDAGMRFGKCMNGKCHC-NH2 | Δ36-38, OSK1-O16, D20, -amide | 1139 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hLys]PCKDAGMRFGKCMNGKCHC-NH2 | Δ36-38, OSK1-hLys 16, D20-amide | 1140 |
| GVIINVKCKISRQCL[hArg]PCKDAGMRFGKCMNGKCHC-NH2 | Δ36-38, OSK1-hArg 16, D20-amide | 1141 |
| GVIINVKCKISRQCL[Cit]PCKDAGMRFGKCMNGKCHC-NH2 | Δ36-38, OSK1-Cit 16, D20-amide | 1142 |
| GVIINVKCKISRQCL[hCit]PCKDAGMRFGKCMNGKCHC-NH2 | Δ36-38, OSK1-hCit16, D20-amide | 1143 |
| GVIINVKCKISRQCL[Dpr]PCKDAGMRFGKCMNGKCHC-NH2 | Δ36-38, OSK1-Dpr 16, D20-amide | 1144 |
| GVIINVKCKISRQCLOPCKDAGMRFGKCMNGKCAC-NH2 | Δ36-38, OSK1-O16, D20, A34-amide | 1145 |
| GVIINVKCKISRQCL[hLys]PCKDAGMRFGKCMNGKCAC-NH2 | Δ36-38, OSK1-hLys 16, D20, A34-amide | 1146 |
| GVIINVKCKISRQCL[hArg]PCKDAGMRFGKCMNGKCAC-NH2 | Δ36-38, OSK1-hArg 16, D20, A34-amide | 1147 |
| GVIINVKCKISRQCL[Cit]PCKDAGMRFGKCMNGKCAC-NH2 | Δ36-38, OSK1-Cit 16, D20, A34-amide | 1148 |
| GVIINVKCKISRQCL[hCit]PCKDAGMRFGKCMNGKCHC-NH2 | Δ36-38, OSK1-hCit16, D20, A34 | 1149 |
| GVIINVKCKISRQCL[Dpr]PCKDAGMRFGKCMNGKCAC-NH2 | Δ36-38, OSK1-Dpr 16, D20, A34-amide | 1150 |
| GVIINVKCKISRQCL[Dab]PCKDAGMRFGKCMNGKCAC-NH2 | Δ36-38, OSK1-Dab 16, D20, A34-amide | 1151 |
| GVIINVKCKISRQCLKPCKDAGMRFGKCMNGKCHCYGG-NH2 | OSK1-O16, D20, Y36, G37, G38-amide | 1152 |
| GVIINVKCKISRQCLOPCKDAGMRFGKCMNGKCHCYGG-NH2 | OSK1-O16, D20, Y36, G37, G38 | 1153 |
| GVIINVKCKISRQCL[hLys]PCKDAGMRFGKCMNGKCHCYGG-NH2 | OSK1-hLys 16, D20, Y36, G37, G38-amide | 1154 |
| GVIINVKCKISRQCL[hArg]PCKDAGMRFGKCMNGKCHCYGG-NH2 | OSK1-hArg 16, D20, Y36, G37, G38-amide | 1155 |
| GVIINVKCKISRQCL[Cit]PCKDAGMRFGKCMNGKCHCYGG-NH2 | OSK1-Cit 16, D20, Y36, G37, G38-amide | 1156 |
| GVIINVKCKISRQCL[hCit]PCKDAGMRFGKCMNGKCHCYGG-NH2 | OSK1-hCit16, D20, Y36, G37, G38-amide | 1157 |
| GVIINVKCKISRQCL[Dpr]PCKDAGMRFGKCMNGKCHCYGG-NH2 | OSK1-Dpr 16, D20, Y36, G37, G38-amide | 1158 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLKPCKDAGMRFGKCMNGKCHCFGG-NH2 | OSK1-K16, D20, F36, G37, G38-amide | 1159 |
| GVIINVKCKISRQCLKPCKDAGMRFGKCMNGKCHCYG-NH2 | Δ38-OSK1-K16, D20, Y36, G37-amide | 1160 |
| GVIINVKCKISRQCLKPCKDAGMRFGKCMNGKCACYG-NH2 | Δ38-OSK1-K16, D20, A34, Y36, G37-amide | 1161 |
| GVIINVKCKISRQCLOPCKDAGMRFGKCMNGKCACYGG-NH2 | OSK1-O16, D20, A34, Y36, G37, G38-amide | 1162 |
| GVIINVKCKISRQCL[hLys]PCKDAGMRFGKCMNGKCACYGG-NH2 | OSK1-hLys 16, D20, A34, Y36, G37, G38-amide | 1163 |
| GVIINVKCKISRQCL[hArg]PCKDAGMRFGKCMNGKCACYGG-NH2 | OSK1-hArg 16, D20, A34, Y36, G37, G38-amide | 1164 |
| GVIINVKCKISRQCL[Cit]PCKDAGMRFGKCMNGKCACYGG-NH2 | OSK1-Cit 16, D20, A34, Y36, G37, G38 | 1165 |
| GVIINVKCKISRQCL[hCit]PCKDAGMRFGKCMNGKCACYGG-NH2 | OSK1-hCit16, D20, A34, Y3, G37, G38-amide | 1166 |
| GVIINVKCKISRQCL[Dpr]PCKDAGMRFGKCMNGKCACYGG-NH2 | OSK1-Dpr 16, D20, A34, Y36, G37, G38-amide | 1167 |
| GVIINVKCKISRQCL[Dab]PCKDAGMRFGKCMNGKCACYGG-NH2 | OSK1-Dab 16, D20, A34, Y36, G37, G38-amide | 1168 |
| GVIINVKCKISRQCLKPCKDAGMRFGKCMNGKCACYGG-NH2 | OSK1-K16, D20, A34, Y36, G37, G38-amide | 1169 |
| GVIINVKCKISRQCLOPCKDAGMRFGKCMNGKCHCGGG-NH2 | OSK1-O16, D20, G36-38-amide | 1170 |
| GVIINVKCKISRQCL[hLys]PCKDAGMRFGKCMNGKCHCGGG-NH2 | OSK1-hLys 16, D20, G36-38-amide | 1171 |
| GVIINVKCKISRQCL[hArg]PCKDAGMRFGKCMNGKCHCGGG-NH2 | OSK1-hArg 16, D20, G36-38-amide | 1172 |
| GVIINVKCKISRQCL[Cit]PCKDAGMRFGKCMNGKCHCGGG-NH2 | OSK1-Cit 16, D20, G36-38-amide | 1173 |
| GVIINVKCKISRQCL[hCit]PCKDAGMRFGKCMNGKCHCGGG-NH2 | OSK1-hCit16, D20, G36-38-amide | 1174 |
| GVIINVKCKISRQCL[Dpr]PCKDAGMRFGKCMNGKCHCGGG-NH2 | OSK1-Dpr 16, D20, G36-38-amide | 1175 |
| GVIINVKCKISRQCLKPCKDAGMRFGKCMNGKCACGGG-NH2 | OSK1-K16, D20, A34, G36-38-amide | 1176 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCLOPCKDAGMRFGKCMNGKCACFGG-NH2 | OSK1-O16, D20, A34, F36, G37-38-amide | 1177 |
| GVIINVKCKISRQCLOPCKDAGMRFGKCMNGKCACGGG-NH2 | OSK1-O16, D20, A34, G36-38-amide | 1178 |
| GVIINVKCKISRQCL[hLys]PCKDAGMRFGKCMNGKCACGGG-NH2 | OSK1-hLys 16, D20, A34, G36-38-amide | 1179 |
| GVIINVKCKISRQCL[hArg]PCKDAGMRFGKCMNGKCACGGG-NH2 | OSK1-hArg 16, D20, A34, G36-38-amide | 1180 |
| GVIINVKCKISRQCL[Cit]PCKDAGMRFGKCMNGKCACGGG-NH2 | OSK1-Cit 16, D20, A34, G36-38-amide | 1181 |
| GVIINVKCKISRQCL[hCit]PCKDAGMRFGKCMNGKCACGGG-NH2 | OSK1-hCit16, D20, A34, G36-38-amide | 1182 |
| GVIINVKCKISRQCL[Dpr]PCKDAGMRFGKCMNGKCACGGG-NH2 | OSK1-Dpr 16, D20, A34, G36-38-amide | 1183 |
| GVIINVKCKISRQCL[Dab]PCKDAGMRFGKCMNGKCACGGG-NH2 | OSK1-Dab 16, D20, A34, G36-38-amide | 1184 |
| GVIINVKCKISRQCLOPCKEAGMRFGKCMNGKCHCTPK-NH2 | OSK1-O16, E20-amide | 1185 |
| GVIINVKCKISRQCL[hLys]PCKEAGMRFGKCMNGKCHCTPK-NH2 | OSK1-hLys 16, E20-amide | 1186 |
| GVIINVKCKISRQCL[hArg]PCKEAGMRFGKCMNGKCHCTPK-NH2 | OSK1-hArg 16, E20-amide | 1187 |
| GVIINVKCKISRQCL[Cit]PCKEAGMRFGKCMNGKCHCTPK-NH2 | OSK1-Cit 16, E20-amide | 1188 |
| GVIINVKCKISRQCL[hCit]PCKEAGMRFGKCMNGKCHCTPK-NH2 | OSK1-hCit16, E20-amide | 1189 |
| GVIINVKCKISRQCL[Dpr]PCKEAGMRFGKCMNGKCHCTPK-NH2 | OSK1-Dpr 16, E20-amide | 1190 |
| GVIINVKCKISRQCL[Dab]PCKEAGMRFGKCMNGKCHCTPK-NH2 | OSK1-Dab 16, E20-amide | 1191 |
| GVIINVKCKISRQCLOPCKEAGMRFGKCMNGKCHCYPK-NH2 | OSK1-O16, E20, Y36-amide | 1192 |
| GVIINVKCKISRQCL[hLys]PCKEAGMRFGKCMNGKCHCYPK-NH2 | OSK1-hLys 16, E20, Y36-amide | 1193 |
| GVIINVKCKISRQCL[hArg]PCKEAGMRFGKCMNGKCHCYPK-NH2 | OSK1-hArg 16, E20, Y36-amide | 1194 |
| GVIINVKCKISRQCL[Cit]PCKEAGMRFGKCMNGKCHCYPK-NH2 | OSK1-Cit 16, E20, Y36-amide | 1195 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hCit]PCKEAGMRFGKCMNGKCHCYPK-NH2 | OSK1-hCit16, E20, Y36-amide | 1196 |
| GVIINVKCKISRQCL[Dpr]PCKEAGMRFGKCMNGKCHCYPK-NH2 | OSK1-Dpr 16, E20, Y36-amide | 1197 |
| GVIINVKCKISRQCL[Dab]PCKEAGMRFGKCMNGKCHCYPK-NH2 | OSK1-Dab 16, E20, Y36-amide | 1198 |
| GVIINVKCKISRQCLOPCKEAGMRFGKCMNGKCACTPK-NH2 | OSK1-O16, E20, A34-amide | 1199 |
| GVIINVKCKISRQCL[hLys]PCKEAGMRFGKCMNGKCACTPK-NH2 | OSK1-hLys 16, E20, A34-amide | 1200 |
| GVIINVKCKISRQCL[hArg]PCKEAGMRFGKCMNGKCACTPK-NH2 | OSK1-hArg 16, E20, A34-amide | 1201 |
| GVIINVKCKISRQCL[Cit]PCKEAGMRFGKCMNGKCACTPK-NH2 | OSK1-Cit 16, E20, A34-amide | 1202 |
| GVIINVKCKISRQCL[hCit]PCKEAGMRFGKCMNGKCACTPK-NH2 | OSK1-hCit16, E20, A34-amide | 1203 |
| GVIINVKCKISRQCL[Dpr]PCKEAGMRFGKCMNGKCACTPK-NH2 | OSK1-Dpr 16, E20, A34-amide | 1204 |
| GVIINVKCKISRQCL[Dab]PCKEAGMRFGKCMNGKCACTPK-NH2 | OSK1-Dab 16, E20, A34-amide | 1205 |
| GVIINVKCKISRQCLOPCKEAGMRFGKCMNGKCHC-NH2 | Δ36-38, OSK1-O16, E20, -amide | 1206 |
| GVIINVKCKISRQCL[hLys]PCKEAGMRFGKCMNGKCHC-NH2 | Δ36-38, OSK1-hLys 16, E20-amide | 1207 |
| GVIINVKCKISRQCL[hArg]PCKEAGMRFGKCMNGKCHC-NH2 | Δ36-38, OSK1-hArg 16, E20-amide | 1208 |
| GVIINVKCKISRQCL[Cit]PCKEAGMRFGKCMNGKCHC-NH2 | Δ36-38, OSK1-Cit 16, E20-amide | 1209 |
| GVIINVKCKISRQCL[hCit]PCKEAGMRFGKCMNGKCHC-NH2 | Δ36-38, OSK1-hCit16, E20-amide | 1210 |
| GVIINVKCKISRQCL[Dpr]PCKEAGMRFGKCMNGKCHC-NH2 | Δ36-38, OSK1-Dpr 16, E20-amide | 1211 |
| GVIINVKCKISRQCLOPCKEAGMRFGKCMNGKCAC-NH2 | Δ36-38, OSK1-O16, E20, A34-amide | 1212 |
| GVIINVKCKISRQCL[hLys]PCKEAGMRFGKCMNGKCAC-NH2 | Δ36-38, OSK1-hLys16, E20, A34-amide | 1213 |

TABLE 7-continued

| Orthochirus scrobiculosus (OSK1) peptide and OSK1 peptide analog sequences | | |
|---|---|---|
| Sequence/structure | Short-hand designation | SEQ ID NO: |
| GVIINVKCKISRQCL[hArg]PCKEAGMRFGKCMNGKCAC-NH2 | Δ36-38, OSK1-hArg16, E20, A34-amide | 1214 |
| GVIINVKCKISRQCL[Cit]PCKEAGMRFGKCMNGKCAC-NH2 | Δ36-38, OSK1-Cit 16, E20, A34-amide | 1215 |
| GVIINVKCKISRQCL[hCit]PCKEAGMRFGKCMNGKCHC-NH2 | Δ36-38, OSK1-hCit16, E20, A34-amide | 1216 |
| GVIINVKCKISRQCL[Dpr]PCKEAGMRFGKCMNGKCAC-NH2 | Δ36-38, OSK1-Dpr 16, E20, A34-amide | 1217 |
| GVIINVKCKISRQCL[Dab]PCKEAGMRFGKCMNGKCAC-NH2 | Δ36-38, OSK1-Dab 16, E20, A34-amide | 1218 |
| GVIINVKCKISRQCLKPCKEAGMRFGKCMNGKCHCWGG-NH2 | OSK1-O16, E20, W36, G37, G38-amide | 1219 |
| GVIINVKCKISRQCLOPCKEAGMRFGKCMNGKCHCYGG-NH2 | OSK1-O16, E20, Y36, G37, G38-amide | 1220 |
| GVIINVKCKISRQCL[hLys]PCKEAGMRFGKCMNGKCHCYGG-NH2 | OSK1-hLys 16, E20, Y36, G37, G38-amide | 1221 |
| GVIINVKCKISRQCL[hArg]PCKEAGMRFGKCMNGKCHCYGG-NH2 | OSK1-hArg 16, E20, Y36, G37, G38-amide | 1222 |
| GVIINVKCKISRQCL[Cit]PCKEAGMRFGKCMNGKCHCYGG-NH2 | OSK1-Cit 16, E20, Y36, G37, G38-amide | 1223 |
| GVIINVKCKISRQCL[hCit]PCKEAGMRFGKCMNGKCHCYGG-NH2 | OSK1-hCit 16, E20, Y36, G37, G38-amide | 1224 |
| GVIINVKCKISRQCL[Dpr]PCKEAGMRFGKCMNGKCHCYGG-NH2 | OSK1-Dpr 16, E20, Y36, G37, G38-amide | 1225 |
| GVIINVKCKISRQCL[Dab]PCKEAGMRFGKCMNGKCHCYGG-NH2 | OSK1-Dpr 16, E20, Y36, G37, G38-amide | 1226 |
| GVIINVKCKISRQCLKPCKEAGMRFGKCMNGKCACYGG-NH2 | OSK1-K16, E20, A34, Y36, G37, G38-amide | 1227 |
| GVIINVKCKISRQCLOPCKEAGMRFGKCMNGKCACYGG-NH2 | OSK1-O16, E20, A34, Y36, G37, G38-amide | 1228 |
| GVIINVKCKISRQCL[hLys]PCKEAGMRFGKCMNGKCACYGG-NH2 | OSK1-hLys 16, E20, A34, Y36, G37, G38-amide | 1229 |
| GVIINVKCKISRQCL[hArg]PCKEAGMRFGKCMNGKCACYGG-NH2 | OSK1-hArg 16, E20, A34, Y36, G37, G38-amide | 1230 |
| GVIINVKCKISRQCL[Cit]PCKEAGMRFGKCMNGKCACYGG-NH2 | OSK1-Cit 16, E20, A34, Y36, G37, G38-amide | 1231 |

TABLE 7-continued

Orthochirus scrobiculosus (OSK1) peptide and OSK1 peptide analog sequences

| Sequence/structure | Short-hand designation | SEQ ID NO: |
|---|---|---|
| GVIINVKCKISRQCL[hCit]PCKEAGMRFGKCMNGKCHCYGG-NH2 | OSK1-hCit 16, E20, A34, Y3, G37, G38-amide | 1232 |
| GVIINVKCKISRQCL[Dpr]PCKEAGMRFGKCMNGKCACYGG-NH2 | OSK1-Dpr 16, E20, A34, Y36, G37, G38-amide | 1233 |
| GVIINVKCKISRQCL[Dab]PCKEAGMRFGKCMNGKCACYGG-NH2 | OSK1-Dab 16, E20, A34, Y36, G37, G38-amide | 1234 |
| GVIINVKCKISRQCLOPCKEAGMRFGKCMNGKCHCGGG-NH2 | OSK1-O16, E20, G36-38-amide | 1235 |
| GVIINVKCKISRQCL[hLys]PCKEAGMRFGKCMNGKCHCGGG-NH2 | OSK1-hLys 16, E20, G36-38-amide | 1236 |
| GVIINVKCKISRQCL[hArg]PCKEAGMRFGKCMNGKCHCGGG-NH2 | OSK1-hArg 16, E20, G36-38-amide | 1237 |
| GVIINVKCKISRQCL[Cit]PCKEAGMRFGKCMNGKCHCGGG-NH2 | OSK1-Cit 16, E20, G36-38-amide | 1238 |
| GVIINVKCKISRQCL[hCit]PCKEAGMRFGKCMNGKCHCGGG-NH2 | OSK1-hCit 16, E20, G36-38-amide | 1239 |
| GVIINVKCKISRQCL[Dpr]PCKEAGMRFGKCMNGKCHCGGG-NH2 | OSK1-Dpr 16, E20, G36-38-amide | 1240 |
| GVIINVKCKISRQCLOPCKEAGMRFGKCMNGKCACGGG-NH2 | OSK1-O16, E20, A34, G36-38-amide | 1241 |
| GVIINVKCKISRQCL[hLys]PCKEAGMRFGKCMNGKCACGGG-NH2 | OSK1-hLys 16, E20, A34, G36-38-amide | 1242 |
| GVIINVKCKISRQCL[hArg]PCKEAGMRFGKCMNGKCACGGG-NH2 | OSK1-hArg 16, E20, A34, G36-38-amide | 1243 |
| GVIINVKCKISRQCL[Cit]PCKEAGMRFGKCMNGKCACGGG-NH2 | OSK1-Cit 16, E20, A34, G36-38-amide | 1244 |
| GVIINVKCKISRQCL[hCit]PCKEAGMRFGKCMNGKCACTP-NH2 | Δ38 OSK1-hCit 16, E20, A34-amide | 1245 |
| GVIINVKCKISRQCL[Dpr]PCKEAGMRFGKCMNGKCACGGG-NH2 | OSK1-Dpr 16, E20, A34, G36-38-amide | 1246 |
| GVIINVKCKISRQCL[Dab]PCKEAGMRFGKCMNGKCACGGG-NH2 | OSK1-Dab 16, E20, A34, G36-38-amide | 1247 |
| GVIINVKCKISRQCLKPCK[Cpa]AGMRFGKCMNGKCACYGG-NH2 | OSK1-K 16, CPA20, A34, Y36, G37, G38-amide | 1248 |
| GVIINVKCKISRQCLKPCK[Cpa]AGMRFGKCMNGKCACGGG-NH2 | OSK1-K 16, CPA20, A34, G36-38-amide | 1249 |

TABLE 7-continued

| Orthochirus scrobiculosus (OSK1) peptide and OSK1 peptide analog sequences | | |
|---|---|---|
| Sequence/structure | Short-hand designation | SEQ ID NO: |
| GVIINVKCKISRQCLKPCK[Cpa]AGMRFGKCMNGKCACY-NH2 | Δ37-38OSK1-K 16, CPA20, A34, Y36-amide | 1250 |
| Ac-GVIINVKCKISRQCLKPCKDAGMRFGKCMNGKCACYGG-NH2 | Acetyl-OSK1-K 16, D20, A34, Y36, G37, G38-amide | 1251 |
| GVIINVKCKISRQCLKPCK[Aad]AGMRFGKCMNGKCACYGG-NH2 | OSK1-K 16, Aad20, A34, Y36, G37, G38-amide | 1252 |
| GVIINVKCKISRQCLKPCK[Aad]AGMRFGKCMNGKCHCYGG-NH2 | OSK1-K 16, Aad20, Y36, G37, G38-amide | 1253 |
| GVIINVKCKISRQCLKPCK[Aad]AGMRFGKCMNGKCACYGG | OSK1-K 16, Aad20, A34, Y36, G37, G38 | 1254 |
| GVIINVKCKISRQCLHPCKDAGMRFGKCMNGKCACYGG-NH2 | OSK1-H 16, D20, A34, Y36, G37, G38-amide | 1255 |
| GVIINVKCKISRQCLHPCKDAGMRFGKCMNGKCACYGG | OSK1-H 16, D20, A34, Y36, G37, G38 | 1256 |
| GVIINVKCKISRQCLHPCKDAGMRFGKCMNGKCACY-NH2 | Δ37-38-OSK1-H 16, D20, A34, Y36-amide | 1257 |
| GVIINVKCKISRQCLHPCKDAGMRFGKCMNGKCHCYGG-NH2 | OSK1-H 16, D20, A34, Y36, G37, G38-amide | 1258 |
| GVIINVKCKISRQCLHPCKDAGMRFGKCMNGKCHCYGG | OSK1-H 16, D20, A34, Y36, G37, G38 | 1259 |
| GVIINVKCKISRQCLHPCKDAGMRFGKCMNGKCHCYPK | OSK1-H 16, D20, A34, Y36, | 1260 |
| GVIINVKCKISRQCLHPCKDAGMRFGKCMNGKCAC | Δ36-38 OSK1-H 16, D20, A34, Y36, | 1261 |
| GVIINVKCKISRQCLKPCKDAGMRFGKCMNGKCAC[1Nal]GG-NH2 | OSK1-K 16, D20, A34, 1Nal36, G37, G38-amide | 1262 |
| GVIINVKCKISRQCLKPCKDAGMRFGKCMNGKCAC[1Nal]PK-NH2 | OSK1-K 16, D20, A34, 1Nal36-amide | 1263 |
| GVIINVKCKISRQCLKPCKDAGMRFGKCMNGKCAC[2Nal]GG-NH2 | OSK1-K 16, D20, A34, 2Nal36, G37, G38-amide | 1264 |
| GVIINVKCKISRQCLKPCKDAGMRFGKCMNGKCAC[Cha]GG-NH2 | OSK1-K 16, D20, A34, Cha36, G37, G38-amide | 1265 |
| GVIINVKCKISRQCLKPCKDAGMRFGKCMNGKCAC[MePhe]GG-NH2 | OSK1-K 16, D20, A34, MePhe36, G37, G38-amide | 1266 |
| GVIINVKCKISRQCLKPCKDAGMRFGKCMNGKCAC[BiPhA]GG-NH2 16, D20, A34, | OSK1-K BiPhA36, G37, G38-amide | 1267 |

TABLE 7-continued

| Orthochirus scrobiculosus (OSK1) peptide and OSK1 peptide analog sequences | | |
|---|---|---|
| Sequence/structure | Short-hand designation | SEQ ID NO: |
| GVIINVKCKISRQCLKPCKDAGMRFGKCMNGKC[Aib]CYGG-NH2 | OSK1-K 16, D20, Aib34, Y36, G37, G38-amide | 1268 |
| GVIINVKCKISRQCLKPCKDAGMRFGKCMNGKC[Abu]CYGG-NH2 | OSK1-K 16, D20, Abu34, Y36, G37, G38-amide | 1269 |
| GVIINVKCKISRQCLKPCKDAGMRFGKCMNGKCAC[1Nal] | Δ37-38 OSK1-H 16, D20, A34, 1Nal36, -amide | 1270 |
| GVIINVKCKISRQCLHPCKDAGMRFGKCMNGKCAC[1Nal]GG-NH2 | OSK1-H 16, D20, A34, 1Nal36, G37, G38-amide | 1271 |
| GVIINVKCKISRQCLKPCKDAGMRFGKCMNGKCAC[4Bip]-NH2 | Δ37-38 OSK1-H 16, D20, A34, 4Bip 36, -amide | 1272 |
| GVIINVKCKISRQCLHPCKDAGMRFGKCMNGKCAC[4Bip]GG-NH2 | OSK1-H 16, D20, A34, 4Bip 36, G37, G38-amide | 1273 |
| GVIINVKCKISRQCLKPCKDAGMRFGKCMNGKCHCGGG | OSK1-K16, E20, G36-38 | 1274 |

TABLE 7A

| Additional useful OSK1 peptide analog sequences | |
|---|---|
| SEQ ID NO | Sequence |
| 1391 | **GVIINVKCKISAQCLKPCRDAGMRFGKCMNGKCACTPK** |
| 1392 | GVIINVKCKISAQCLKPCKDAGMRFGKCMNGKCHCTPK |
| 1393 | GVIINVKCKISPQCLKPCKDAGIRFGKCINGKCACTPK |
| 1394 | GVIINVKCKISRQCLKPCKEAGMRFGKCMNGKCACTPK |
| 1395 | GGGGSGVIINVKCKISRQCLEPCKKAGMRFGKCMNGKCHCTPK |
| 1396 | GVIINVKCKISRQCLKPCKDAGMRFGKCMNGKCHC |
| 1397 | GVIINVKCKISPQCLOPCKEAGMRFGKCMNGKCHCTY[Nle] |
| 1398 | GVIINVKCKISPQCLKPCKDAGMRFGKCMNGKCHCTY[Nle] |
| 1399 | GVIINVKCKISRQCLKPCKDAGMRFGKCMNGKCHCGGG |
| 1400 | AVIINVKCKISRQCLEPCKKAGMRFGKCMNGKCHCTPK |
| 1401 | G**A**IINVKCKISRQCLEPCKKAGMRFGKCMNGKCHCTPK |
| 1402 | GV**A**INVKCKISRQCLEPCKKAGMRFGKCMNGKCHCTPK |
| 1403 | GVI**A**NVKCKISRQCLEPCKKAGMRFGKCMNGKCHCTPK |
| 1404 | GVII**A**VKCKISRQCLEPCKKAGMRFGKCMNGKCHCTPK |
| 1405 | GVIIN**A**KCKISRQCLEPCKKAGMRFGKCMNGKCHCTPK |
| 1406 | GVIINV**A**CKISRQCLEPCKKAGMRFGKCMNGKCHCTPK |

TABLE 7A-continued

| Additional useful OSK1 peptide analog sequences | |
|---|---|
| SEQ ID NO | Sequence |
| 1407 | GVIINVKC**A**ISRQCLEPCKKAGMRFGKCMNGKCHCTPK |
| 1408 | GVIINVKCK**A**SRQCLEPCKKAGMRFGKCMNGKCHCTPK |
| 1409 | GVIINVKCKI**A**RQCLEPCKKAGMRFGKCMNGKCHCTPK |
| 1410 | GVIINVKCKIS**A**QCLEPCKKAGMRFGKCMNGKCHCTPK |
| 1411 | GVIINVKCKISR**A**CLEPCKKAGMRFGKCMNGKCHCTPK |
| 1412 | GVIINVKCKISRQC**A**EPCKKAGMRFGKCMNGKCHCTPK |
| 1413 | GVIINVKCKISRQCL**A**PCKKAGMRFGKCMNGKCHCTPK |
| 1414 | GVIINVKCKISRQCLE**A**CKKAGMRFGKCMNGKCHCTPK |
| 1415 | GVIINVKCKISRQCLEPC**A**KAGMRFGKCMNGKCHCTPK |
| 1416 | GVIINVKCKISRQCLEPCK**A**AGMRFGKCMNGKCHCTPK |
| 1417 | GVIINVKCKISRQCLEPCKK**A**GMRFGKCMNGKCHCTPK |
| 1418 | GVIINVKCKISRQCLEPCKK**A**AMRFGKCMNGKCHCTPK |
| 1419 | GVIINVKCKISRQCLEPCKKAG**A**RFGKCMNGKCHCTPK |
| 1420 | GVIINVKCKISRQCLEPCKKAGM**A**FGKCMNGKCHCTPK |
| 1421 | GVIINVKCKISRQCLEPCKKAGMR**A**GKCMNGKCHCTPK |

TABLE 7A-continued

Additional useful OSK1 peptide analog sequences

| SEQ ID NO | Sequence |
|---|---|
| 1422 | GVIINVKCKISRQCLEPCKKAGMRF**A**KCMNGKCHCTPK |
| 1423 | GVIINVKCKISRQCLEPCKKAGMRFG**A**CMNGKCHCTPK |
| 1424 | GVIINVKCKISRQCLEPCKKAGMRFGKC**A**NGKCHCTPK |
| 1425 | GVIINVKCKISRQCLEPCKKAGMRFGKCM**A**GKCHCTPK |
| 1426 | GVIINVKCKISRQCLEPCKKAGMRFGKCMN**A**KCHCTPK |
| 1427 | GVIINVKCKISRQCLEPCKKAGMRFGKCMNG**A**CHCTPK |
| 1428 | GVIINVKCKISRQCLEPCKKAGMRFGKCMNGKC**A**CTPK |
| 1429 | GVIINVKCKISRQCLEPCKKAGMRFGKCMNGKCHC**A**PK |
| 1430 | GVIINVKCKISRQCLEPCKKAGMRFGKCMNGKCHCT**A**K |
| 1431 | GVIINVKCKISRQCLEPCKKAGMRFGKCMNGKCHCTP**A** |
| 1432 | RVIINVKCKISRQCLEPCKKAGMRFGKCMNGKCHCTPK |
| 1433 | G**R**IINVKCKISRQCLEPCKKAGMRFGKCMNGKCHCTPK |
| 1434 | GV**R**INVKCKISRQCLEPCKKAGMRFGKCMNGKCHCTPK |
| 1435 | GVI**R**NVKCKISRQCLEPCKKAGMRFGKCMNGKCHCTPK |
| 1436 | GVII**R**VKCKISRQCLEPCKKAGMRFGKCMNGKCHCTPK |
| 1437 | GVIIN**R**KCKISRQCLEPCKKAGMRFGKCMNGKCHCTPK |
| 1438 | GVIINV**R**CKISRQCLEPCKKAGMRFGKCMNGKCHCTPK |
| 1439 | GVIINVKC**R**ISRQCLEPCKKAGMRFGKCMNGKCHCTPK |
| 1440 | GVIINVKCK**R**SRQCLEPCKKAGMRFGKCMNGKCHCTPK |
| 1441 | GVIINVKCKI**R**RQCLEPCKKAGMRFGKCMNGKCHCTPK |
| 1442 | GVIINVKCKISR**R**CLEPCKKAGMRFGKCMNGKCHCTPK |
| 1443 | GVIINVKCKISRQC**R**EPCKKAGMRFGKCMNGKCHCTPK |
| 1444 | GVIINVKCKISRQCL**R**PCKKAGMRFGKCMNGKCHCTPK |
| 1445 | GVIINVKCKISRQCLE**R**CKKAGMRFGKCMNGKCHCTPK |
| 1446 | GVIINVKCKISRQCLEPC**R**KAGMRFGKCMNGKCHCTPK |
| 1447 | GVIINVKCKISRQCLEPCK**R**AGMRFGKCMNGKCHCTPK |
| 1448 | GVIINVKCKISRQCLEPCKK**R**GMRFGKCMNGKCHCTPK |
| 1449 | GVIINVKCKISRQCLEPCKKA**R**MRFGKCMNGKCHCTPK |
| 1450 | GVIINVKCKISRQCLEPCKKAG**R**RFGKCMNGKCHCTPK |
| 1451 | GVIINVKCKISRQCLEPCKKAGM**R**RGKCMNGKCHCTPK |
| 1452 | GVIINVKCKISRQCLEPCKKAGMRF**R**KCMNGKCHCTPK |
| 1453 | GVIINVKCKISRQCLEPCKKAGMRFG**R**CMNGKCHCTPK |
| 1454 | GVIINVKCKISRQCLEPCKKAGMRFGKC**R**NGKCHCTPK |
| 1455 | GVIINVKCKISRQCLEPCKKAGMRFGKCM**R**GKCHCTPK |
| 1456 | GVIINVKCKISRQCLEPCKKAGMRFGKCMN**R**KCHCTPK |
| 1457 | GVIINVKCKISRQCLEPCKKAGMRFGKCMNG**R**CHCTPK |
| 1458 | GVIINVKCKISRQCLEPCKKAGMRFGKCMNGKC**R**CTPK |
| 1459 | GVIINVKCKISRQCLEPCKKAGMRFGKCMNGKCHC**R**PK |
| 1460 | GVIINVKCKISRQCLEPCKKAGMRFGKCMNGKCHCT**R**K |
| 1461 | GVIINVKCKISRQCLEPCKKAGMRFGKCMNGKCHCTP**R** |
| 1462 | EVIINVKCKISRQCLEPCKKAGMRFGKCMNGKCHCTPK |
| 1463 | G**E**IINVKCKISRQCLEPCKKAGMRFGKCMNGKCHCTPK |
| 1464 | GV**E**INVKCKISRQCLEPCKKAGMRFGKCMNGKCHCTPK |
| 1465 | GVI**E**NVKCKISRQCLEPCKKAGMRFGKCMNGKCHCTPK |
| 1466 | GVII**E**VKCKISRQCLEPCKKAGMRFGKCMNGKCHCTPK |
| 1467 | GVIIN**E**KCKISRQCLEPCKKAGMRFGKCMNGKCHCTPK |
| 1468 | GVIINV**E**CKISRQCLEPCKKAGMRFGKCMNGKCHCTPK |
| 1469 | GVIINVKC**E**ISRQCLEPCKKAGMRFGKCMNGKCHCTPK |
| 1470 | GVIINVKCK**E**SRQCLEPCKKAGMRFGKCMNGKCHCTPK |
| 1471 | GVIINVKCKI**E**RQCLEPCKKAGMRFGKCMNGKCHCTPK |
| 1472 | GVIINVKCKIS**E**QCLEPCKKAGMRFGKCMNGKCHCTPK |
| 1473 | GVIINVKCKISR**E**CLEPCKKAGMRFGKCMNGKCHCTPK |
| 1474 | GVIINVKCKISRQC**E**EPCKKAGMRFGKCMNGKCHCTPK |
| 1475 | GVIINVKCKISRQCLE**E**CKKAGMRFGKCMNGKCHCTPK |
| 1476 | GVIINVKCKISRQCLEPC**E**KAGMRFGKCMNGKCHCTPK |
| 1477 | GVIINVKCKISRQCLEPCK**E**AGMRFGKCMNGKCHCTPK |
| 1478 | GVIINVKCKISRQCLEPCKK**E**GMRFGKCMNGKCHCTPK |
| 1479 | GVIINVKCKISRQCLEPCKKA**E**MRFGKCMNGKCHCTPK |
| 1480 | GVIINVKCKISRQCLEPCKKAG**E**RFGKCMNGKCHCTPK |
| 1481 | GVIINVKCKISRQCLEPCKKAGM**E**FGKCMNGKCHCTPK |
| 1482 | GVIINVKCKISRQCLEPCKKAGMR**E**GKCMNGKCHCTPK |
| 1483 | GVIINVKCKISRQCLEPCKKAGMRF**E**KCMNGKCHCTPK |
| 1484 | GVIINVKCKISRQCLEPCKKAGMRFG**E**CMNGKCHCTPK |
| 1485 | GVIINVKCKISRQCLEPCKKAGMRFGKC**E**NGKCHCTPK |
| 1486 | GVIINVKCKISRQCLEPCKKAGMRFGKCM**E**GKCHCTPK |
| 1487 | GVIINVKCKISRQCLEPCKKAGMRFGKCMN**E**KCHCTPK |
| 1488 | GVIINVKCKISRQCLEPCKKAGMRFGKCMNG**E**CHCTPK |
| 1489 | GVIINVKCKISRQCLEPCKKAGMRFGKCMNGKC**E**CTPK |
| 1490 | GVIINVKCKISRQCLEPCKKAGMRFGKCMNGKCHC**E**PK |
| 1491 | GVIINVKCKISRQCLEPCKKAGMRFGKCMNGKCHCT**E**K |
| 1492 | GVIINVKCKISRQCLEPCKKAGMRFGKCMNGKCHCTP**E** |
| 1493 | [1-Nal]VIINVKCKISRQCLEPCKKAGMRFGKCMNGKCHCTPK |
| 1494 | G[**1-Nal**]IINVKCKISRQCLEPCKKAGMRFGKCMNGKCHCTPK |

TABLE 7A-continued

Additional useful OSK1 peptide analog sequences

| SEQ ID NO | Sequence |
|---|---|
| 1495 | GV[**1-Nal**]INVKCKISRQCLEPCKKAGMRFGKCMNGKCHCTPK |
| 1496 | GVI[**1-Nal**]NVKCKISRQCLEPCKKAGMRFGKCMNGKCHCTPK |
| 1497 | GVII[**1-Nal**]VKCKISRQCLEPCKKAGMRFGKCMNGKCHCTPK |
| 1498 | GVIIN[**1-Nal**]KCKISRQCLEPCKKAGMRFGKCMNGKCHCTPK |
| 1499 | GVIINV[**1-Nal**]CKISRQCLEPCKKAGMRFGKCMNGKCHCTPK |
| 1500 | GVIINVKC[**1-Nal**]ISRQCLEPCKKAGMRFGKCMNGKCHCTPK |
| 1501 | GVIINVKCK[**1-Nal**]SRQCLEPCKKAGMRFGKCMNGKCHCTPK |
| 1502 | GVIINVKCKI[**1-Nal**]RQCLEPCKKAGMRFGKCMNGKCHCTPK |
| 1503 | GVIINVKCKIS[**1-Nal**]QCLEPCKKAGMRFGKCMNGKCHCTPK |
| 1504 | GVIINVKCKISR[**1-Nal**]CLEPCKKAGMRFGKCMNGKCHCTPK |
| 1505 | GVIINVKCKISRQC[**1-Nal**]EPCKKAGMRFGKCMNGKCHCTPK |
| 1506 | GVIINVKCKISRQCL[**1-Nal**]PCKKAGMRFGKCMNGKCHCTPK |
| 1507 | GVIINVKCKISRQCLE[**1-Nal**]CKKAGMRFGKCMNGKCHCTPK |
| 1508 | GVIINVKCKISRQCLEPC[**1-Nal**]KAGMRFGKCMNGKCHCTPK |
| 1509 | GVIINVKCKISRQCLEPCK[**1-Nal**]AGMRFGKCMNGKCHCTPK |
| 1510 | GVIINVKCKISRQCLEPCKK[**1-Nal**]GMRFGKCMNGKCHCTPK |
| 1511 | GVIINVKCKISRQCLEPCKKA[**1-Nal**]MRFGKCMNGKCHCTPK |
| 1512 | GVIINVKCKISRQCLEPCKKAG[**1-Nal**]RFGKCMNGKCHCTPK |
| 1513 | GVIINVKCKISRQCLEPCKKAGM[**1-Nal**]FGKCMNGKCHCTPK |
| 1514 | GVIINVKCKISRQCLEPCKKAGMR[**1-Nal**]GKCMNGKCHCTPK |
| 1515 | GVIINVKCKISRQCLEPCKKAGMRF[**1-Nal**]KCMNGKCHCTPK |
| 1516 | GVIINVKCKISRQCLEPCKKAGMRFG[**1-Nal**]CMNGKCHCTPK |
| 1517 | GVIINVKCKISRQCLEPCKKAGMRFGKC[**1-Nal**]NGKCHCTPK |
| 1518 | GVIINVKCKISRQCLEPCKKAGMRFGKCM[**1-Nal**]GKCHCTPK |
| 1519 | GVIINVKCKISRQCLEPCKKAGMRFGKCMN[**1-Nal**]KCHCTPK |
| 1520 | GVIINVKCKISRQCLEPCKKAGMRFGKCMNG[**1-Nal**]CHCTPK |
| 1521 | GVIINVKCKISRQCLEPCKKAGMRFGKCMNGKC[**1-Nal**]CTPK |
| 1522 | GVIINVKCKISRQCLEPCKKAGMRFGKCMNGKCHC[**1-Nal**]PK |
| 1523 | GVIINVKCKISRQCLEPCKKAGMRFGKCMNGKCHCT[**1-Nal**]K |
| 1524 | GVIINVKCKISRQCLEPCKKAGMRFGKCMNGKCHCTP[**1-Nal**] |
| 1525 | Ac-AVIINVKCKISRQCLEPCKKAGMRFGKCMNGKCHCTPK |
| 1526 | Ac-GAIINVKCKISRQCLEPCKKAGMRFGKCMNGKCHCTPK |
| 1527 | Ac-GVAINVKCKISRQCLEPCKKAGMRFGKCMNGKCHCTPK |
| 1528 | Ac-GVIANVKCKISRQCLEPCKKAGMRFGKCMNGKCHCTPK |
| 1529 | Ac-GVIIAVKCKISRQCLEPCKKAGMRFGKCMNGKCHCTPK |
| 1530 | Ac-GVIINAKCKISRQCLEPCKKAGMRFGKCMNGKCHCTPK |
| 1531 | Ac-GVIINVACKISRQCLEPCKKAGMRFGKCMNGKCHCTPK |
| 1532 | Ac-GVIINVKCAISRQCLEPCKKAGMRFGKCMNGKCHCTPK |
| 1533 | Ac-GVIINVKCKASRQCLEPCKKAGMRFGKCMNGKCHCTPK |
| 1534 | Ac-GVIINVKCKIARQCLEPCKKAGMRFGKCMNGKCHCTPK |
| 1535 | Ac-GVIINVKCKISAQCLEPCKKAGMRFGKCMNGKCHCTPK |
| 1536 | Ac-GVIINVKCKISRACLEPCKKAGMRFGKCMNGKCHCTPK |
| 1537 | Ac-GVIINVKCKISRQCAEPCKKAGMRFGKCMNGKCHCTPK |
| 1538 | Ac-GVIINVKCKISRQCLAPCKKAGMRFGKCMNGKCHCTPK |
| 1539 | Ac-GVIINVKCKISRQCLEACKKAGMRFGKCMNGKCHCTPK |
| 1540 | Ac-GVIINVKCKISRQCLEPCAKAGMRFGKCMNGKCHCTPK |
| 1541 | Ac-GVIINVKCKISRQCLEPCKAAGMRFGKCMNGKCHCTPK |
| 1542 | Ac-GVIINVKCKISRQCLEPCKKAAMRFGKCMNGKCHCTPK |
| 1543 | Ac-GVIINVKCKISRQCLEPCKKAGARFGKCMNGKCHCTPK |
| 1544 | Ac-GVIINVKCKISRQCLEPCKKAGMAFGKCMNGKCHCTPK |
| 1545 | Ac-GVIINVKCKISRQCLEPCKKAGMRAGKCMNGKCHCTPK |
| 1546 | Ac-GVIINVKCKISRQCLEPCKKAGMRFAKCMNGKCHCTPK |
| 1547 | Ac-GVIINVKCKISRQCLEPCKKAGMRFGACMNGKCHCTPK |
| 1548 | Ac-GVIINVKCKISRQCLEPCKKAGMRFGKCANGKCHCTPK |
| 1549 | Ac-GVIINVKCKISRQCLEPCKKAGMRFGKCMAGKCHCTPK |
| 1550 | Ac-GVIINVKCKISRQCLEPCKKAGMRFGKCMNAKCHCTPK |
| 1551 | Ac-GVIINVKCKISRQCLEPCKKAGMRFGKCMNGACHCTPK |
| 1552 | Ac-GVIINVKCKISRQCLEPCKKAGMRFGKCMNGKCACTPK |
| 1553 | Ac-GVIINVKCKISRQCLEPCKKAGMRFGKCMNGKCHCAPK |
| 1554 | Ac-GVIINVKCKISRQCLEPCKKAGMRFGKCMNGKCHCTAK |
| 1555 | Ac-GVIINVKCKISRQCLEPCKKAGMRFGKCMNGKCHCTPA |
| 1556 | Ac-RVIINVKCKISRQCLEPCKKAGMRFGKCMNGKCHCTPK |
| 1557 | Ac-GRIINVKCKISRQCLEPCKKAGMRFGKCMNGKCHCTPK |
| 1558 | Ac-GVRINVKCKISRQCLEPCKKAGMRFGKCMNGKCHCTPK |
| 1559 | Ac-GVIRNVKCKISRQCLEPCKKAGMRFGKCMNGKCHCTPK |
| 1560 | Ac-GVIIRVKCKISRQCLEPCKKAGMRFGKCMNGKCHCTPK |
| 1561 | Ac-GVIINRKCKISRQCLEPCKKAGMRFGKCMNGKCHCTPK |
| 1562 | Ac-GVIINVRCKISRQCLEPCKKAGMRFGKCMNGKCHCTPK |
| 1563 | Ac-GVIINVKCRISRQCLEPCKKAGMRFGKCMNGKCHCTPK |
| 1564 | Ac-GVIINVKCKRSRQCLEPCKKAGMRFGKCMNGKCHCTPK |
| 1565 | Ac-GVIINVKCKIRRQCLEPCKKAGMRFGKCMNGKCHCTPK |
| 1566 | Ac-GVIINVKCKISRRCLEPCKKAGMRFGKCMNGKCHCTPK |
| 1567 | Ac-GVIINVKCKISRQCREPCKKAGMRFGKCMNGKCHCTPK |

TABLE 7A-continued

Additional useful OSK1 peptide analog sequences

| SEQ ID NO | Sequence |
|---|---|
| 1568 | Ac-GVIINVKCKISRQCLRPCKKAGMRFGKCMNGKCHCTPK |
| 1569 | Ac-GVIINVKCKISRQCLERCKKAGMRFGKCMNGKCHCTPK |
| 1570 | Ac-GVIINVKCKISRQCLEPCRKAGMRFGKCMNGKCHCTPK |
| 1571 | Ac-GVIINVKCKISRQCLEPCKRAGMRFGKCMNGKCHCTPK |
| 1572 | Ac-GVIINVKCKISRQCLEPCKKRGMRFGKCMNGKCHCTPK |
| 1573 | Ac-GVIINVKCKISRQCLEPCKKARMRFGKCMNGKCHCTPK |
| 1574 | Ac-GVIINVKCKISRQCLEPCKKAGRRFGKCMNGKCHCTPK |
| 1575 | Ac-GVIINVKCKISRQCLEPCKKAGMRRGKCMNGKCHCTPK |
| 1576 | Ac-GVIINVKCKISRQCLEPCKKAGMRFRKCMNGKCHCTPK |
| 1577 | Ac-GVIINVKCKISRQCLEPCKKAGMRFGRCMNGKCHCTPK |
| 1578 | Ac-GVIINVKCKISRQCLEPCKKAGMRFGKCRNGKCHCTPK |
| 1579 | Ac-GVIINVKCKISRQCLEPCKKAGMRFGKCMRGKCHCTPK |
| 1580 | Ac-GVIINVKCKISRQCLEPCKKAGMRFGKCMNRKCHCTPK |
| 1581 | Ac-GVIINVKCKISRQCLEPCKKAGMRFGKCMNGRCHCTPK |
| 1582 | Ac-GVIINVKCKISRQCLEPCKKAGMRFGKCMNGKCRCTPK |
| 1583 | Ac-GVIINVKCKISRQCLEPCKKAGMRFGKCMNGKCHCRPK |
| 1584 | Ac-GVIINVKCKISRQCLEPCKKAGMRFGKCMNGKCHCTRK |
| 1585 | Ac-GVIINVKCKISRQCLEPCKKAGMRFGKCMNGKCHCTPR |
| 1586 | Ac-EVIINVKCKISRQCLEPCKKAGMRFGKCMNGKCHCTPK |
| 1587 | Ac-GEIINVKCKISRQCLEPCKKAGMRFGKCMNGKCHCTPK |
| 1588 | Ac-GVEINVKCKISRQCLEPCKKAGMRFGKCMNGKCHCTPK |
| 1589 | Ac-GVIENVKCKISRQCLEPCKKAGMRFGKCMNGKCHCTPK |
| 1590 | Ac-GVIIEVKCKISRQCLEPCKKAGMRFGKCMNGKCHCTPK |
| 1591 | Ac-GVIINEKCKISRQCLEPCKKAGMRFGKCMNGKCHCTPK |
| 1592 | Ac-GVIINVECKISRQCLEPCKKAGMRFGKCMNGKCHCTPK |
| 1593 | Ac-GVIINVKCEISRQCLEPCKKAGMRFGKCMNGKCHCTPK |
| 1594 | Ac-GVIINVKCKESRQCLEPCKKAGMRFGKCMNGKCHCTPK |
| 1595 | Ac-GVIINVKCKIERQCLEPCKKAGMRFGKCMNGKCHCTPK |
| 1596 | Ac-GVIINVKCKISEQCLEPCKKAGMRFGKCMNGKCHCTPK |
| 1597 | Ac-GVIINVKCKISRECLEPCKKAGMRFGKCMNGKCHCTPK |
| 1598 | Ac-GVIINVKCKISRQCEEPCKKAGMRFGKCMNGKCHCTPK |
| 1599 | Ac-GVIINVKCKISRQCLEECKKAGMRFGKCMNGKCHCTPK |
| 1600 | Ac-GVIINVKCKISRQCLEPCEKAGMRFGKCMNGKCHCTPK |
| 1601 | Ac-GVIINVKCKISRQCLEPCKEAGMRFGKCMNGKCHCTPK |
| 1602 | Ac-GVIINVKCKISRQCLEPCKKEGMRFGKCMNGKCHCTPK |
| 1603 | Ac-GVIINVKCKISRQCLEPCKKAEMRFGKCMNGKCHCTPK |
| 1604 | Ac-GVIINVKCKISRQCLEPCKKAGERFGKCMNGKCHCTPK |

TABLE 7A-continued

Additional useful OSK1 peptide analog sequences

| SEQ ID NO | Sequence |
|---|---|
| 1605 | Ac-GVIINVKCKISRQCLEPCKKAGMEFGKCMNGKCHCTPK |
| 1606 | Ac-GVIINVKCKISRQCLEPCKKAGMREGKCMNGKCHCTPK |
| 1607 | Ac-GVIINVKCKISRQCLEPCKKAGMRFEKCMNGKCHCTPK |
| 1608 | Ac-GVIINVKCKISRQCLEPCKKAGMRFGECMNGKCHCTPK |
| 1609 | Ac-GVIINVKCKISRQCLEPCKKAGMRFGKCENGKCHCTPK |
| 1610 | Ac-GVIINVKCKISRQCLEPCKKAGMRFGKCMEGKCHCTPK |
| 1611 | Ac-GVIINVKCKISRQCLEPCKKAGMRFGKCMNEKCHCTPK |
| 1612 | Ac-GVIINVKCKISRQCLEPCKKAGMRFGKCMNGECHCTPK |
| 1613 | Ac-GVIINVKCKISRQCLEPCKKAGMRFGKCMNGKCECTPK |
| 1614 | Ac-GVIINVKCKISRQCLEPCKKAGMRFGKCMNGKCHCEPK |
| 1615 | Ac-GVIINVKCKISRQCLEPCKKAGMRFGKCMNGKCHCTEK |
| 1616 | Ac-GVIINVKCKISRQCLEPCKKAGMRFGKCMNGKCHCTPE |
| 1617 | Ac-[1-Nal]VIINVKCKISRQCLEPCKKAGMRFGKCMNGKCHC TPK |
| 1618 | Ac-G[1-Nal]IINVKCKISRQCLEPCKKAGMRFGKCMNGKCHC TPK |
| 1619 | Ac-GV[1-Nal]INVKCKISRQCLEPCKKAGMRFGKCMNGKCHC TPK |
| 1620 | Ac-GVI[1-Nal]NVKCKISRQCLEPCKKAGMRFGKCMNGKCHC TPK |
| 1621 | Ac-GVII[1-Nal]VKCKISRQCLEPCKKAGMRFGKCMNGKCHC TPK |
| 1622 | Ac-GVIIN[1-Nal]KCKISRQCLEPCKKAGMRFGKCMNGKCHC TPK |
| 1623 | Ac-GVIINV[1-Nal]CKISRQCLEPCKKAGMRFGKCMNGKCHC TPK |
| 1624 | Ac-GVIINVKC[1-Nal]ISRQCLEPCKKAGMRFGKCMNGKCHC TPK |
| 1625 | Ac-GVIINVKCK[1-Nal]SRQCLEPCKKAGMRFGKCMNGKCHC TPK |
| 1626 | Ac-GVIINVKCKI[1-Nal]RQCLEPCKKAGMRFGKCMNGKCHC TPK |
| 1627 | Ac-GVIINVKCKIS[1-Nal]QCLEPCKKAGMRFGKCMNGKCHC TPK |
| 1628 | Ac-GVIINVKCKISR[1-Nal]CLEPCKKAGMRFGKCMNGKCHC TPK |
| 1629 | Ac-GVIINVKCKISRQC[1-Nal]EPCKKAGMRFGKCMNGKCHC TPK |
| 1630 | Ac-GVIINVKCKISRQCL[1-Nal]PCKKAGMRFGKCMNGKCHC TPK |
| 1631 | Ac-GVIINVKCKISRQCLE[1-Nal]CKKAGMRFGKCMNGKCHC TPK |
| 1632 | Ac-GVIINVKCKISRQCLEPC[1-Nal]KAGMRFGKCMNGKCHC TPK |

TABLE 7A-continued

Additional useful OSK1 peptide analog sequences

| SEQ ID NO | Sequence |
|---|---|
| 1633 | Ac-GVIINVKCKISRQCLEPCK[1-Nal]AGMRFGKCMNGKCHCTPK |
| 1634 | Ac-GVIINVKCKISRQCLEPCKK[1-Nal]GMRFGKCMNGKCHCTPK |
| 1635 | Ac-GVIINVKCKISRQCLEPCKKA[1-Nal]MRFGKCMNGKCHCTPK |
| 1636 | Ac-GVIINVKCKISRQCLEPCKKAG[1-Nal]RFGKCMNGKCHCTPK |
| 1637 | Ac-GVIINVKCKISRQCLEPCKKAGM[1-Nal]FGKCMNGKCHCTPK |
| 1638 | Ac-GVIINVKCKISRQCLEPCKKAGMR[1-Nal]GKCMNGKCHCTPK |
| 1639 | Ac-GVIINVKCKISRQCLEPCKKAGMRF[1-Nal]KCMNGKCHCTPK |
| 1640 | Ac-GVIINVKCKISRQCLEPCKKAGMRFG[1-Nal]CMNGKCHCTPK |
| 1641 | Ac-GVIINVKCKISRQCLEPCKKAGMRFGKC[1-Nal]NGKCHCTPK |
| 1642 | Ac-GVIINVKCKISRQCLEPCKKAGMRFGKCM[1-Nal]GKCHCTPK |
| 1643 | Ac-GVIINVKCKISRQCLEPCKKAGMRFGKCMN[1-Nal]KCHCTPK |
| 1644 | Ac-GVIINVKCKISRQCLEPCKKAGMRFGKCMNG[1-Nal]CHCTPK |
| 1645 | Ac-GVIINVKCKISRQCLEPCKKAGMRFGKCMNGKC[1-Nal]CTPK |
| 1646 | Ac-GVIINVKCKISRQCLEPCKKAGMRFGKCMNGKCHC[1-Nal]PK |
| 1647 | Ac-GVIINVKCKISRQCLEPCKKAGMRFGKCMNGKCHCT[1-Nal]K |
| 1648 | Ac-GVIINVKCKISRQCLEPCKKAGMRFGKCMNGKCHCTP[1-Nal] |
| 1649 | AVIINVKCKISRQCLEPCKKAGMRFGKCMNGKCHCTPK-amide |
| 1650 | GAIINVKCKISRQCLEPCKKAGMRFGKCMNGKCHCTPK-amide |
| 1651 | GVAINVKCKISRQCLEPCKKAGMRFGKCMNGKCHCTPK-amide |
| 1652 | GVIANVKCKISRQCLEPCKKAGMRFGKCMNGKCHCTPK-amide |
| 1653 | GVIIAVKCKISRQCLEPCKKAGMRFGKCMNGKCHCTPK-amide |
| 1654 | GVIINAKCKISRQCLEPCKKAGMRFGKCMNGKCHCTPK-amide |
| 1655 | GVIINVACKISRQCLEPCKKAGMRFGKCMNGKCHCTPK-amide |
| 1656 | GVIINVKCAISRQCLEPCKKAGMRFGKCMNGKCHCTPK-amide |
| 1657 | GVIINVKCKASRQCLEPCKKAGMRFGKCMNGKCHCTPK-amide |
| 1658 | GVIINVKCKIARQCLEPCKKAGMRFGKCMNGKCHCTPK-amide |
| 1659 | GVIINVKCKISAQCLEPCKKAGMRFGKCMNGKCHCTPK-amide |
| 1660 | GVIINVKCKISRACLEPCKKAGMRFGKCMNGKCHCTPK-amide |
| 1661 | GVIINVKCKISRQCAEPCKKAGMRFGKCMNGKCHCTPK-amide |

TABLE 7A-continued

Additional useful OSK1 peptide analog sequences

| SEQ ID NO | Sequence |
|---|---|
| 1662 | GVIINVKCKISRQCLAPCKKAGMRFGKCMNGKCHCTPK-amide |
| 1663 | GVIINVKCKISRQCLEACKKAGMRFGKCMNGKCHCTPK-amide |
| 1664 | GVIINVKCKISRQCLEPCAKAGMRFGKCMNGKCHCTPK-amide |
| 1665 | GVIINVKCKISRQCLEPCKAAGMRFGKCMNGKCHCTPK-amide |
| 1666 | GVIINVKCKISRQCLEPCKKAGMRFGKCMNGKCHCTPK-amide |
| 1667 | GVIINVKCKISRQCLEPCKKAAMRFGKCMNGKCHCTPK-amide |
| 1668 | GVIINVKCKISRQCLEPCKKAGARFGKCMNGKCHCTPK-amide |
| 1669 | GVIINVKCKISRQCLEPCKKAGMAFGKCMNGKCHCTPK-amide |
| 1670 | GVIINVKCKISRQCLEPCKKAGMRAGKCMNGKCHCTPK-amide |
| 1671 | GVIINVKCKISRQCLEPCKKAGMRFAKCMNGKCHCTPK-amide |
| 1672 | GVIINVKCKISRQCLEPCKKAGMRFGACMNGKCHCTPK-amide |
| 1673 | GVIINVKCKISRQCLEPCKKAGMRFGKCANGKCHCTPK-amide |
| 1674 | GVIINVKCKISRQCLEPCKKAGMRFGKCMAGKCHCTPK-amide |
| 1675 | GVIINVKCKISRQCLEPCKKAGMRFGKCMNAKCHCTPK-amide |
| 1676 | GVIINVKCKISRQCLEPCKKAGMRFGKCMNGACHCTPK-amide |
| 1677 | GVIINVKCKISRQCLEPCKKAGMRFGKCMNGKCACTPK-amide |
| 1678 | GVIINVKCKISRQCLEPCKKAGMRFGKCMNGKCHCAPK-amide |
| 1679 | GVIINVKCKISRQCLEPCKKAGMRFGKCMNGKCHCTAK-amide |
| 1680 | GVIINVKCKISRQCLEPCKKAGMRFGKCMNGKCHCTPA-amide |
| 1681 | RVIINVKCKISRQCLEPCKKAGMRFGKCMNGKCHCTPK-amide |
| 1682 | GRIINVKCKISRQCLEPCKKAGMRFGKCMNGKCHCTPK-amide |
| 1683 | GVRINVKCKISRQCLEPCKKAGMRFGKCMNGKCHCTPK-amide |
| 1684 | GVIRNVKCKISRQCLEPCKKAGMRFGKCMNGKCHCTPK-amide |
| 1685 | GVIIRVKCKISRQCLEPCKKAGMRFGKCMNGKCHCTPK-amide |
| 1686 | GVIINRKCKISRQCLEPCKKAGMRFGKCMNGKCHCTPK-amide |
| 1687 | GVIINVRCKISRQCLEPCKKAGMRFGKCMNGKCHCTPK-amide |
| 1688 | GVIINVKCRISRQCLEPCKKAGMRFGKCMNGKCHCTPK-amide |
| 1689 | GVIINVKCKRSRQCLEPCKKAGMRFGKCMNGKCHCTPK-amide |
| 1690 | GVIINVKCKIRRQCLEPCKKAGMRFGKCMNGKCHCTPK-amide |
| 1691 | GVIINVKCKISRRCLEPCKKAGMRFGKCMNGKCHCTPK-amide |
| 1692 | GVIINVKCKISRQCREPCKKAGMRFGKCMNGKCHCTPK-amide |
| 1693 | GVIINVKCKISRQCLRPCKKAGMRFGKCMNGKCHCTPK-amide |
| 1694 | GVIINVKCKISRQCLERCKKAGMRFGKCMNGKCHCTPK-amide |
| 1695 | GVIINVKCKISRQCLEPCRKAGMRFGKCMNGKCHCTPK-amide |
| 1696 | GVIINVKCKISRQCLEPCKRAGMRFGKCMNGKCHCTPK-amide |
| 1697 | GVIINVKCKISRQCLEPCKKRGMRFGKCMNGKCHCTPK-amide |

TABLE 7A-continued

Additional useful OSK1 peptide analog sequences

| SEQ ID NO | Sequence |
|---|---|
| 1698 | GVIINVKCKISRQCLEPCKKARMRFGKCMNGKCHCTPK-amide |
| 1699 | GVIINVKCKISRQCLEPCKKAGRRFGKCMNGKCHCTPK-amide |
| 1700 | GVIINVKCKISRQCLEPCKKAGMRRGKCMNGKCHCTPK-amide |
| 1701 | GVIINVKCKISRQCLEPCKKAGMRFRKCMNGKCHCTPK-amide |
| 1702 | GVIINVKCKISRQCLEPCKKAGMRFGRCMNGKCHCTPK-amide |
| 1703 | GVIINVKCKISRQCLEPCKKAGMRFGKCRNGKCHCTPK-amide |
| 1704 | GVIINVKCKISRQCLEPCKKAGMRFGKCMRGKCHCTPK-amide |
| 1705 | GVIINVKCKISRQCLEPCKKAGMRFGKCMNRKCHCTPK-amide |
| 1706 | GVIINVKCKISRQCLEPCKKAGMRFGKCMNGRCHCTPK-amide |
| 1707 | GVIINVKCKISRQCLEPCKKAGMRFGKCMNGKCRCTPK-amide |
| 1708 | GVIINVKCKISRQCLEPCKKAGMRFGKCMNGKCHCRPK-amide |
| 1709 | GVIINVKCKISRQCLEPCKKAGMRFGKCMNGKCHCTRK-amide |
| 1710 | GVIINVKCKISRQCLEPCKKAGMRFGKCMNGKCHCTPR-amide |
| 1711 | EVIINVKCKISRQCLEPCKKAGMRFGKCMNGKCHCTPK-amide |
| 1712 | GEIINVKCKISRQCLEPCKKAGMRFGKCMNGKCHCTPK-amide |
| 1713 | GVEINVKCKISRQCLEPCKKAGMRFGKCMNGKCHCTPK-amide |
| 1714 | GVIENVKCKISRQCLEPCKKAGMRFGKCMNGKCHCTPK-amide |
| 1715 | GVIIEVKCKISRQCLEPCKKAGMRFGKCMNGKCHCTPK-amide |
| 1716 | GVIINEKCKISRQCLEPCKKAGMRFGKCMNGKCHCTPK-amide |
| 1717 | GVIINVECKISRQCLEPCKKAGMRFGKCMNGKCHCTPK-amide |
| 1718 | GVIINVKCEISRQCLEPCKKAGMRFGKCMNGKCHCTPK-amide |
| 1719 | GVIINVKCKESRQCLEPCKKAGMRFGKCMNGKCHCTPK-amide |
| 1720 | GVIINVKCKIERQCLEPCKKAGMRFGKCMNGKCHCTPK-amide |
| 1721 | GVIINVKCKISEQCLEPCKKAGMRFGKCMNGKCHCTPK-amide |
| 1722 | GVIINVKCKISRECLEPCKKAGMRFGKCMNGKCHCTPK-amide |
| 1723 | GVIINVKCKISRQCEEPCKKAGMRFGKCMNGKCHCTPK-amide |
| 1724 | GVIINVKCKISRQCLEECKKAGMRFGKCMNGKCHCTPK-amide |
| 1725 | GVIINVKCKISRQCLEPCEKAGMRFGKCMNGKCHCTPK-amide |
| 1726 | GVIINVKCKISRQCLEPCKEAGMRFGKCMNGKCHCTPK-amide |
| 1727 | GVIINVKCKISRQCLEPCKKEGMRFGKCMNGKCHCTPK-amide |
| 1728 | GVIINVKCKISRQCLEPCKKAEMRFGKCMNGKCHCTPK-amide |
| 1729 | GVIINVKCKISRQCLEPCKKAGERFGKCMNGKCHCTPK-amide |
| 1730 | GVIINVKCKISRQCLEPCKKAGMEFGKCMNGKCHCTPK-amide |
| 1731 | GVIINVKCKISRQCLEPCKKAGMREGKCMNGKCHCTPK-amide |
| 1732 | GVIINVKCKISRQCLEPCKKAGMRFEKCMNGKCHCTPK-amide |
| 1733 | GVIINVKCKISRQCLEPCKKAGMRFGECMNGKCHCTPK-amide |
| 1734 | GVIINVKCKISRQCLEPCKKAGMRFGKCENGKCHCTPK-amide |

TABLE 7A-continued

Additional useful OSK1 peptide analog sequences

| SEQ ID NO | Sequence |
|---|---|
| 1735 | GVIINVKCKISRQCLEPCKKAGMRFGKCMEGKCHCTPK-amide |
| 1736 | GVIINVKCKISRQCLEPCKKAGMRFGKCMNEKCHCTPK-amide |
| 1737 | GVIINVKCKISRQCLEPCKKAGMRFGKCMNGECHCTPK-amide |
| 1738 | GVIINVKCKISRQCLEPCKKAGMRFGKCMNGKCECTPK-amide |
| 1739 | GVIINVKCKISRQCLEPCKKAGMRFGKCMNGKCHCEPK-amide |
| 1740 | GVIINVKCKISRQCLEPCKKAGMRFGKCMNGKCHCTEK-amide |
| 1741 | GVIINVKCKISRQCLEPCKKAGMRFGKCMNGKCHCTPE-amide |
| 1742 | [1-Nal]VIINVKCKISRQCLEPCKKAGMRFGKCMNGKCHCTPK-amide |
| 1743 | G[1-Nal]IINVKCKISRQCLEPCKKAGMRFGKCMNGKCHCTPK-amide |
| 1744 | GV[1-Nal]INVKCKISRQCLEPCKKAGMRFGKCMNGKCHCTPK-amide |
| 1745 | GVI[1-Nal]NVKCKISRQCLEPCKKAGMRFGKCMNGKCHCTPK-amide |
| 1746 | GVII[1-Nal]VKCKISRQCLEPCKKAGMRFGKCMNGKCHCTPK-amide |
| 1747 | GVIIN[1-Nal]KCKISRQCLEPCKKAGMRFGKCMNGKCHCTPK-amide |
| 1748 | GVIINV[1-Nal]CKISRQCLEPCKKAGMRFGKCMNGKCHCTPK-amide |
| 1749 | GVIINVKC[1-Nal]ISRQCLEPCKKAGMRFGKCMNGKCHCTPK-amide |
| 1750 | GVIINVKCK[1-Nal]SRQCLEPCKKAGMRFGKCMNGKCHCTPK-amide |
| 1751 | GVIINVKCKI[1-Nal]RQCLEPCKKAGMRFGKCMNGKCHCTPK-amide |
| 1752 | GVIINVKCKIS[1-Nal]QCLEPCKKAGMRFGKCMNGKCHCTPK-amide |
| 1753 | GVIINVKCKISR[1-Nal]CLEPCKKAGMRFGKCMNGKCHCTPK-amide |
| 1754 | GVIINVKCKISRQC[1-Nal]EPCKKAGMRFGKCMNGKCHCTPK-amide |
| 1755 | GVIINVKCKISRQCL[1-Nal]PCKKAGMRFGKCMNGKCHCTPK-amide |
| 1756 | GVIINVKCKISRQCLE[1-Nal]CKKAGMRFGKCMNGKCHCTPK-amide |
| 1757 | GVIINVKCKISRQCLEPC[1-Nal]KAGMRFGKCMNGKCHCTPK-amide |
| 1758 | GVIINVKCKISRQCLEPCK[1-Nal]AGMRFGKCMNGKCHCTPK-amide |
| 1759 | GVIINVKCKISRQCLEPCKK[1-Nal]GMRFGKCMNGKCHCTPK-amide |
| 1760 | GVIINVKCKISRQCLEPCKKA[1-Nal]MRFGKCMNGKCHCTPK-amide |

TABLE 7A-continued

Additional useful OSK1 peptide analog sequences

| SEQ ID NO | Sequence |
|---|---|
| 1761 | GVIINVKCKISRQCLEPCKKAG[1-Nal]RFGKCMNGKCHCTPK-amide |
| 1762 | GVIINVKCKISRQCLEPCKKAGM[1-Nal]FGKCMNGKCHCTPK-amide |
| 1763 | GVIINVKCKISRQCLEPCKKAGMR[1-Nal]GKCMNGKCHCTPK-amide |
| 1764 | GVIINVKCKISRQCLEPCKKAGMRF[1-Nal]KCMNGKCHCTPK-amide |
| 1765 | GVIINVKCKISRQCLEPCKKAGMRFG[1-Nal]CMNGKCHCTPK-amide |
| 1766 | GVIINVKCKISRQCLEPCKKAGMRFGKC[1-Nal]NGKCHCTPK-amide |
| 1767 | GVIINVKCKISRQCLEPCKKAGMRFGKCM[1-Nal]GKCHCTPK-amide |
| 1768 | GVIINVKCKISRQCLEPCKKAGMRFGKCMN[1-Nal]KCHCTPK-amide |
| 1769 | GVIINVKCKISRQCLEPCKKAGMRFGKCMNG[1-Nal]CHCTPK-amide |
| 1770 | GVIINVKCKISRQCLEPCKKAGMRFGKCMNGKC[1-Nal]CTPK-amide |
| 1771 | GVIINVKCKISRQCLEPCKKAGMRFGKCMNGKCHC[1-Nal]PK-amide |
| 1772 | GVIINVKCKISRQCLEPCKKAGMRFGKCMNGKCHCT[1-Nal]K-amide |
| 1773 | GVIINVKCKISRQCLEPCKKAGMRFGKCMNGKCHCTP[1-Nal]-amide |
| 1774 | Ac-AVIINVKCKISRQCLEPCKKAGMRFGKCMNGKCHCTPK-amide |
| 1775 | Ac-GAIINVKCKISRQCLEPCKKAGMRFGKCMNGKCHCTPK-amide |
| 1776 | Ac-GVAINVKCKISRQCLEPCKKAGMRFGKCMNGKCHCTPK-amide |
| 1777 | Ac-GVIANVKCKISRQCLEPCKKAGMRFGKCMNGKCHCTPK-amide |
| 1778 | Ac-GVIIAVKCKISRQCLEPCKKAGMRFGKCMNGKCHCTPK-amide |
| 1779 | Ac-GVIINAKCKISRQCLEPCKKAGMRFGKCMNGKCHCTPK-amide |
| 1780 | Ac-GVIINVACKISRQCLEPCKKAGMRFGKCMNGKCHCTPK-amide |
| 1781 | Ac-GVIINVKCAISRQCLEPCKKAGMRFGKCMNGKCHCTPK-amide |
| 1782 | Ac-GVIINVKCKASRQCLEPCKKAGMRFGKCMNGKCHCTPK-amide |
| 1783 | Ac-GVIINVKCKIARQCLEPCKKAGMRFGKCMNGKCHCTPK-amide |
| 1784 | Ac-GVIINVKCKISAQCLEPCKKAGMRFGKCMNGKCHCTPK-amide |

TABLE 7A-continued

Additional useful OSK1 peptide analog sequences

| SEQ ID NO | Sequence |
|---|---|
| 1785 | Ac-GVIINVKCKISRACLEPCKKAGMRFGKCMNGKCHCTPK-amide |
| 1786 | Ac-GVIINVKCKISRQCAEPCKKAGMRFGKCMNGKCHCTPK-amide |
| 1787 | Ac-GVIINVKCKISRQCLAPCKKAGMRFGKCMNGKCHCTPK-amide |
| 1788 | Ac-GVIINVKCKISRQCLEACKKAGMRFGKCMNGKCHCTPK-amide |
| 1789 | Ac-GVIINVKCKISRQCLEPCAKAGMRFGKCMNGKCHCTPK-amide |
| 1790 | Ac-GVIINVKCKISRQCLEPCKAAGMRFGKCMNGKCHCTPK-amide |
| 1791 | Ac-GVIINVKCKISRQCLEPCKKAAMRFGKCMNGKCHCTPK-amide |
| 1792 | Ac-GVIINVKCKISRQCLEPCKKAGARFGKCMNGKCHCTPK-amide |
| 1793 | Ac-GVIINVKCKISRQCLEPCKKAGMAFGKCMNGKCHCTPK-amide |
| 1794 | Ac-GVIINVKCKISRQCLEPCKKAGMRAGKCMNGKCHCTPK-amide |
| 1795 | Ac-GVIINVKCKISRQCLEPCKKAGMRFAKCMNGKCHCTPK-amide |
| 1796 | Ac-GVIINVKCKISRQCLEPCKKAGMRFGACMNGKCHCTPK-amide |
| 1797 | Ac-GVIINVKCKISRQCLEPCKKAGMRFGKCANGKCHCTPK-amide |
| 1798 | Ac-GVIINVKCKISRQCLEPCKKAGMRFGKCMAGKCHCTPK-amide |
| 1799 | Ac-GVIINVKCKISRQCLEPCKKAGMRFGKCMNAKCHCTPK-amide |
| 1800 | Ac-GVIINVKCKISRQCLEPCKKAGMRFGKCMNGACHCTPK-amide |
| 1801 | Ac-GVIINVKCKISRQCLEPCKKAGMRFGKCMNGKCACTPK-amide |
| 1802 | Ac-GVIINVKCKISRQCLEPCKKAGMRFGKCMNGKCHCAPK-amide |
| 1803 | Ac-GVIINVKCKISRQCLEPCKKAGMRFGKCMNGKCHCTAK-amide |
| 1804 | Ac-GVIINVKCKISRQCLEPCKKAGMRFGKCMNGKCHCTPA-amide |
| 1805 | Ac-RVIINVKCKISRQCLEPCKKAGMRFGKCMNGKCHCTPK-amide |
| 1806 | Ac-GRIINVKCKISRQCLEPCKKAGMRFGKCMNGKCHCTPK-amide |
| 1807 | Ac-GVRINVKCKISRQCLEPCKKAGMRFGKCMNGKCHCTPK-amide |
| 1808 | Ac-GVIRNVKCKISRQCLEPCKKAGMRFGKCMNGKCHCTPK-amide |

TABLE 7A-continued

Additional useful OSK1 peptide analog sequences

| SEQ ID NO | Sequence |
|---|---|
| 1809 | Ac-GVIIRVKCKISRQCLEPCKKAGMRFGKCMNGKCHCTPK-amide |
| 1810 | Ac-GVIINRKCKISRQCLEPCKKAGMRFGKCMNGKCHCTPK-amide |
| 1811 | Ac-GVIINVRCKISRQCLEPCKKAGMRFGKCMNGKCHCTPK-amide |
| 1812 | Ac-GVIINVKCRISRQCLEPCKKAGMRFGKCMNGKCHCTPK-amide |
| 1813 | Ac-GVIINVKCKRSRQCLEPCKKAGMRFGKCMNGKCHCTPK-amide |
| 1814 | Ac-GVIINVKCKIRRQCLEPCKKAGMRFGKCMNGKCHCTPK-amide |
| 1815 | Ac-GVIINVKCKISRRCLEPCKKAGMRFGKCMNGKCHCTPK-amide |
| 1816 | Ac-GVIINVKCKISRQCREPCKKAGMRFGKCMNGKCHCTPK-amide |
| 1817 | Ac-GVIINVKCKISRQCLRPCKKAGMRFGKCMNGKCHCTPK-amide |
| 1818 | Ac-GVIINVKCKISRQCLERCKKAGMRFGKCMNGKCHCTPK-amide |
| 1819 | Ac-GVIINVKCKISRQCLEPCRKAGMRFGKCMNGKCHCTPK-amide |
| 1820 | Ac-GVIINVKCKISRQCLEPCKRAGMRFGKCMNGKCHCTPK-amide |
| 1821 | Ac-GVIINVKCKISRQCLEPCKKRGMRFGKCMNGKCHCTPK-amide |
| 1822 | Ac-GVIINVKCKISRQCLEPCKKARMRFGKCMNGKCHCTPK-amide |
| 1823 | Ac-GVIINVKCKISRQCLEPCKKAGRRFGKCMNGKCHCTPK-amide |
| 1824 | Ac-GVIINVKCKISRQCLEPCKKAGMRRGKCMNGKCHCTPK-amide |
| 1825 | Ac-GVIINVKCKISRQCLEPCKKAGMRFRKCMNGKCHCTPK-amide |
| 1826 | Ac-GVIINVKCKISRQCLEPCKKAGMRFGRCMNGKCHCTPK-amide |
| 1827 | Ac-GVIINVKCKISRQCLEPCKKAGMRFGKCRNGKCHCTPK-amide |
| 1828 | Ac-GVIINVKCKISRQCLEPCKKAGMRFGKCMRGKCHCTPK-amide |
| 1829 | Ac-GVIINVKCKISRQCLEPCKKAGMRFGKCMNRKCHCTPK-amide |
| 1830 | Ac-GVIINVKCKISRQCLEPCKKAGMRFGKCMNGRCHCTPK-amide |
| 1831 | Ac-GVIINVKCKISRQCLEPCKKAGMRFGKCMNGKCRCTPK-amide |
| 1832 | Ac-GVIINVKCKISRQCLEPCKKAGMRFGKCMNGKCHCRPK-amide |

TABLE 7A-continued

Additional useful OSK1 peptide analog sequences

| SEQ ID NO | Sequence |
|---|---|
| 1833 | Ac-GVIINVKCKISRQCLEPCKKAGMRFGKCMNGKCHCTRK-amide |
| 1834 | Ac-GVIINVKCKISRQCLEPCKKAGMRFGKCMNGKCHCTPR-amide |
| 1835 | Ac-EVIINVKCKISRQCLEPCKKAGMRFGKCMNGKCHCTPK-amide |
| 1836 | Ac-GEIINVKCKISRQCLEPCKKAGMRFGKCMNGKCHCTPK-amide |
| 1837 | Ac-GVEINVKCKISRQCLEPCKKAGMRFGKCMNGKCHCTPK-amide |
| 1838 | Ac-GVIENVKCKISRQCLEPCKKAGMRFGKCMNGKCHCTPK-amide |
| 1839 | Ac-GVIIEVKCKISRQCLEPCKKAGMRFGKCMNGKCHCTPK-amide |
| 1840 | Ac-GVIINEKCKISRQCLEPCKKAGMRFGKCMNGKCHCTPK-amide |
| 1841 | Ac-GVIINVECKISRQCLEPCKKAGMRFGKCMNGKCHCTPK-amide |
| 1842 | Ac-GVIINVKCEISRQCLEPCKKAGMRFGKCMNGKCHCTPK-amide |
| 1843 | Ac-GVIINVKCKESRQCLEPCKKAGMRFGKCMNGKCHCTPK-amide |
| 1844 | Ac-GVIINVKCKIERQCLEPCKKAGMRFGKCMNGKCHCTPK-amide |
| 1845 | Ac-GVIINVKCKISEQCLEPCKKAGMRFGKCMNGKCHCTPK-amide |
| 1846 | Ac-GVIINVKCKISRECLEPCKKAGMRFGKCMNGKCHCTPK-amide |
| 1847 | Ac-GVIINVKCKISRQCEEPCKKAGMRFGKCMNGKCHCTPK-amide |
| 1848 | Ac-GVIINVKCKISRQCLEECKKAGMRFGKCMNGKCHCTPK-amide |
| 1849 | Ac-GVIINVKCKISRQCLEPCEKAGMRFGKCMNGKCHCTPK-amide |
| 1850 | Ac-GVIINVKCKISRQCLEPCKEAGMRFGKCMNGKCHCTPK-amide |
| 1851 | Ac-GVIINVKCKISRQCLEPCKKEGMRFGKCMNGKCHCTPK-amide |
| 1852 | Ac-GVIINVKCKISRQCLEPCKKAEMRFGKCMNGKCHCTPK-amide |
| 1853 | Ac-GVIINVKCKISRQCLEPCKKAGERFGKCMNGKCHCTPK-amide |
| 1854 | Ac-GVIINVKCKISRQCLEPCKKAGMEFGKCMNGKCHCTPK-amide |
| 1855 | Ac-GVIINVKCKISRQCLEPCKKAGMREGKCMNGKCHCTPK-amide |
| 1856 | Ac-GVIINVKCKISRQCLEPCKKAGMRFEKCMNGKCHCTPK-amide |

TABLE 7A-continued

| Additional useful OSK1 peptide analog sequences | |
|---|---|
| SEQ ID NO | Sequence |
| 1857 | Ac-GVIINVKCKISRQCLEPCKKAGMRFGECMNGKCHCTPK-amide |
| 1858 | Ac-GVIINVKCKISRQCLEPCKKAGMRFGKCENGKCHCTPK-amide |
| 1859 | Ac-GVIINVKCKISRQCLEPCKKAGMRFGKCMEGKCHCTPK-amide |
| 1860 | Ac-GVIINVKCKISRQCLEPCKKAGMRFGKCMNEKCHCTPK-amide |
| 1861 | Ac-GVIINVKCKISRQCLEPCKKAGMRFGKCMNGECHCTPK-amide |
| 1862 | Ac-GVIINVKCKISRQCLEPCKKAGMRFGKCMNGKCECTPK-amide |
| 1863 | Ac-GVIINVKCKISRQCLEPCKKAGMRFGKCMNGKCHCEPK-amide |
| 1864 | Ac-GVIINVKCKISRQCLEPCKKAGMRFGKCMNGKCHCTEK-amide |
| 1865 | Ac-GVIINVKCKISRQCLEPCKKAGMRFGKCMNGKCHCTPE-amide |
| 1866 | Ac-[1-Nal]VIINVKCKISRQCLEPCKKAGMRFGKCMNGKCHCTPK-amide |
| 1867 | Ac-G[1-Nal]IINVKCKISRQCLEPCKKAGMRFGKCMNGKCHCTPK-amide |
| 1868 | Ac-GV[1-Nal]INVKCKISRQCLEPCKKAGMRFGKCMNGKCHCTPK-amide |
| 1869 | Ac-GVI[1-Nal]NVKCKISRQCLEPCKKAGMRFGKCMNGKCHCTPK-amide |
| 1870 | Ac-GVII[1-Nal]VKCKISRQCLEPCKKAGMRFGKCMNGKCHCTPK-amide |
| 1871 | Ac-GVIIN[1-Nal]KCKISRQCLEPCKKAGMRFGKCMNGKCHCTPK-amide |
| 1872 | Ac-GVIINV[1-Nal]CKISRQCLEPCKKAGMRFGKCMNGKCHCTPK-amide |
| 1873 | Ac-GVIINVKC[1-Nal]ISRQCLEPCKKAGMRFGKCMNGKCHCTPK-amide |
| 1874 | Ac-GVIINVKCK[1-Nal]SRQCLEPCKKAGMRFGKCMNGKCHCTPK-amide |
| 1875 | Ac-GVIINVKCKI[1-Nal]RQCLEPCKKAGMRFGKCMNGKCHCTPK-amide |
| 1876 | Ac-GVIINVKCKIS[1-Nal]QCLEPCKKAGMRFGKCMNGKCHCTPK-amide |
| 1877 | Ac-GVIINVKCKISR[1-Nal]CLEPCKKAGMRFGKCMNGKCHCTPK-amide |
| 1878 | Ac-GVIINVKCKISRQC[1-Nal]EPCKKAGMRFGKCMNGKCHCTPK-amide |
| 1879 | Ac-GVIINVKCKISRQCL[1-Nal]PCKKAGMRFGKCMNGKCHCTPK-amide |
| 1880 | Ac-GVIINVKCKISRQCLE[1-Nal]CKKAGMRFGKCMNGKCHCTPK-amide |

TABLE 7A-continued

| Additional useful OSK1 peptide analog sequences | |
|---|---|
| SEQ ID NO | Sequence |
| 1881 | Ac-GVIINVKCKISRQCLEPC[1-Nal]KAGMRFGKCMNGKCHCTPK-amide |
| 1882 | Ac-GVIINVKCKISRQCLEPCK[1-Nal]AGMRFGKCMNGKCHCTPK-amide |
| 1883 | Ac-GVIINVKCKISRQCLEPCKK[1-Nal]GMRFGKCMNGKCHCTPK-amide |
| 1884 | Ac-GVIINVKCKISRQCLEPCKKA[1-Nal]MRFGKCMNGKCHCTPK-amide |
| 1885 | Ac-GVIINVKCKISRQCLEPCKKAG[1-Nal]RFGKCMNGKCHCTPK-amide |
| 1886 | Ac-GVIINVKCKISRQCLEPCKKAGM[1-Nal]FGKCMNGKCHCTPK-amide |
| 1887 | Ac-GVIINVKCKISRQCLEPCKKAGMR[1-Nal]GKCMNGKCHCTPK-amide |
| 1888 | Ac-GVIINVKCKISRQCLEPCKKAGMRF[1-Nal]KCMNGKCHCTPK-amide |
| 1889 | Ac-GVIINVKCKISRQCLEPCKKAGMRFG[1-Nal]CMNGKCHCTPK-amide |
| 1890 | Ac-GVIINVKCKISRQCLEPCKKAGMRFGKC[1-Nal]NGKCHCTPK-amide |
| 1891 | Ac-GVIINVKCKISRQCLEPCKKAGMRFGKCM[1-Nal]GKCHCTPK-amide |
| 1892 | Ac-GVIINVKCKISRQCLEPCKKAGMRFGKCMN[1-Nal]KCHCTPK-amide |
| 1893 | Ac-GVIINVKCKISRQCLEPCKKAGMRFGKCMNG[1-Nal]CHCTPK-amide |
| 1894 | Ac-GVIINVKCKISRQCLEPCKKAGMRFGKCMNGKC[1-Nal]CTPK-amide |
| 1895 | Ac-GVIINVKCKISRQCLEPCKKAGMRFGKCMNGKCHC[1-Nal]PK-amide |
| 1896 | Ac-GVIINVKCKISRQCLEPCKKAGMRFGKCMNGKCHCT[1-Nal]K-amide |
| 1897 | Ac-GVIINVKCKISRQCLEPCKKAGMRFGKCMNGKCHCTP[1-Nal]-amide |

TABLE 7B

| Additional useful OSK1 peptide analog sequences: Ala-12 Substituted Series | |
|---|---|
| Sequence/structure | SEQ ID NO: |
| GVIINVKCKISAQCLEPCKKAGMRFGKCMNGKCHCTPK | 1898 |
| GVIINVSCKISAQCLEPCKKAGMRFGKCMNGKCHCTPK | 1899 |
| GVIINVKCKISAQCLKPCKKAGMRFGKCMNGKCHCTPK | 1900 |
| GVIINVKCKISAQCLEPCKDAGMRFGKCMNGKCHCTPK | 1901 |
| GVIINVKCKISAQCLKPCKDAGMRFGKCMNGKCHCTPK | 1902 |

TABLE 7B-continued

| Additional useful OSK1 peptide analog sequences: Ala-12 Substituted Series | |
|---|---|
| Sequence/structure | SEQ ID NO: |
| GVIINVSCKISAQCLKPCKDAGMRFGKCMNGKCHCTPK | 1903 |
| GVIINVKCKISPQCLKPCKDAGMRFGKCMNGKCHCTPK | 1904 |
| GVIINVKCKISAQCLKPCKDAGMRFGKCMNGKCHCYPK | 1905 |
| Ac-GVIINVKCKISPQCLKPCKDAGMRFGKCMNGKCHCTPK | 1906 |
| GVIINVKCKISPQCLKPCKDAGMRFGKCMNGKCHCTPK-amide | 1907 |
| Ac-GVIINVKCKISPQCLKPCKDAGMRFGKCMNGKCHCTPK-amide | 1908 |
| GVIINVKCKISAQCLKPCKDAGMRFGKCMNGKCHCYPK-amide | 1909 |
| Ac-GVIINVKCKISAQCLKPCKDAGMRFGKCMNGKCHCYPK | 1910 |
| Ac-GVIINVKCKISAQCLKPCKDAGMRFGKCMNGKCHCYPK-amide | 1911 |
| GVIINVKCKISAQCLKPCKKAGMRFGKCMNGKCHCTPK-amide | 1912 |
| Ac-GVIINVKCKISAQCLKPCKKAGMRFGKCMNGKCHCTPK | 1913 |
| Ac-GVIINVKCKISAQCLKPCKKAGMRFGKCMNGKCHCTPK-amide | 1914 |
| Ac-GVIINVKCKISAQCLEPCKDAGMRFGKCMNGKCHCTPK | 1915 |
| GVIINVKCKISAQCLEPCKDAGMRFGKCMNCKCHCTPK-amide | 1916 |
| Ac-GVIINVKCKISAQCLEPCKDAGMRFGKCMNGKCHCTPK-amide | 1917 |
| GVIINVKCKISAQCLEPCKKAGMRFGKCMNGKCHCTPK-amide | 1918 |
| Ac-GVIINVKCKISAQCLEPCKKAGMRFGKCMNGKCHCTPK | 1919 |
| Ac-GVIINVKCKISAQCLEPCKKAGMRFGKCMNGKCHCTPK-amide | 1920 |
| GVIINVKCKISAQCLKPCKDAGMRFGKCMNGKCHCTPK-amide | 1921 |
| Ac-GVIINVKCKISAQCLKPCKDAGMRFGKCMNGKCHCTPK | 1922 |
| Ac-GVIINVKCKISAQCLKPCKDAGMRFGKCMNGKCHCTPK-amide | 1923 |
| VIINVKCKISAQCLEPCKKAGMRFGKCMNGKCHCTPK | 1924 |
| Ac-VIINVKCKISAQCLEPCKKAGMRFGKCMNGKCHCTPK | 1925 |
| VIINVKCKISAQCLEPCKKAGMRFGKCMNGKCHCTPK-amide | 1926 |
| Ac-VIINVKCKISAQCLEPCKKAGMRFGKCMNGKCHCTPK-amide | 1927 |
| GVIINVKCKISAQCLEPCKKAGMRFGKCMNGKCACTPK | 1928 |
| Ac-GVIINVKCKISAQCLEPCKKAGMRFGKCMNGKCACTPK | 1929 |
| GVIINVKCKISAQCLEPCKKAGMRFGKCMNGKCACTPK-amide | 1930 |
| Ac-GVIINVKCKISAQCLEPCKKAGMRFGKCMNGKCACTPK-amide | 1931 |
| VIINVKCKISAQCLKPCKDAGMRFGKCMNGKCHCTPK | 1932 |
| Ac-VIINVKCKISAQCLKPCKDAGMRFGKCMNGKCHCTPK | 1933 |
| VIINVKCKISAQCLKPCKDAGMRFGKCMNGKCHCTPK-amide | 1934 |

TABLE 7B-continued

| Additional useful OSK1 peptide analog sequences: Ala-12 Substituted Series | |
|---|---|
| Sequence/structure | SEQ ID NO: |
| Ac-VIINVKCKISAQCLKPCKDAGMRFGKCMNGKCHCTPK-amide | 1935 |
| NVKCKISAQCLKPCKDAGMRFGKCMNGKCHCTPK | 1936 |
| Ac-NVKCKISAQCLKPCKDAGMRFGKCMNGKCHCTPK | 1937 |
| NVKCKISAQCLKPCKDAGMRFGKCMNGKCHCTPK-amide | 1938 |
| Ac-NVKCKISAQCLKPCKDAGMRFGKCMNGKCHCTPK-amide | 1939 |
| KCKISAQCLKPCKDAGMRFGKCMNGKCHCTPK | 1940 |
| Ac-KCKISAQCLKPCKDAGMRFGKCMNGKCHCTPK | 1941 |
| KCKISAQCLKPCKDAGMRFGKCMNGKCHCTPK-amide | 1942 |
| Ac-KCKISAQCLKPCKDAGMRFGKCMNGKCHCTPK-amide | 1943 |
| CKISAQCLKPCKDAGMRFGKCMNGKCHCTPK | 1944 |
| Ac-CKISAQCLKPCKDAGMRFGKCMNGKCHCTPK | 1945 |
| CKISAQCLKPCKDAGMRFGKCMNGKCHCTPK-amide | 1946 |
| Ac-CKISAQCLKPCKDAGMRFGKCMNGKCHCTPK-amide | 1947 |
| GVIINVKCKISAQCLKPCKDAGMRNGKCMNGKCHCTPK | 1948 |
| GVIINVKCKISAQCLKPCKDAGMRNGKCMNGKCHCTPK-amide | 1949 |
| Ac-GVIINVKCKISAQCLKPCKDAGMRNGKCMNGKCHCTPK | 1950 |
| Ac-GVIINVKCKISAQCLKPCKDAGMRNGKCMNGKCHCTPK-amide | 1951 |
| GVIINVKCKISAQCLKPCKDAGMRFGKCMNRKCHCTPK | 1952 |
| GVIINVKCKISAQCLKPCKDAGMRFGKCMNRKCHCTPK-amide | 1953 |
| Ac-GVIINVKCKISAQCLKPCKDAGMRFGKCMNRKCHCTPK | 1954 |
| Ac-GVIINVKCKISAQCLKPCKDAGMRFGKCMNRKCHCTPK-amide | 1955 |
| GVIINVKCKISKQCLKPCRDAGMRFGKCMNGKCHCTPK | 1956 |
| Ac-GVIINVKCKISKQCLKPCRDAGMRFGKCMNGKCHCTPK | 1957 |
| GVIINVKCKISKQCLKPCRDAGMRFGKCMNGKCHCTPK-amide | 1958 |
| Ac-GVIINVKCKISKQCLKPCRDAGMRFGKCMNGKCHCTPK-amide | 1959 |
| TIINVKCKISAQCLKPCKDAGMRFGKCMNGKCHCTPK | 1960 |
| Ac-TIINVKCKISAQCLKPCKDAGMRFGKCMNGKCHCTPK | 1961 |
| TIINVKCKISAQCLKPCKDAGMRFGKCMNGKCHCTPK-amide | 1962 |
| Ac-TIINVKCKISAQCLKPCKDAGMRFGKCMNGKCHCTPK-amide | 1963 |
| GVKINVKCKISAQCLEPCKKAGMRFGKCMNGKCHCTPK | 1964 |
| Ac-GVKINVKCKISAQCLEPCKKAGMRFGKCMNGKCHCTPK | 1965 |
| GVKINVKCKISAQCLEPCKKAGMRFGKCMNGKCHCTPK-amide | 1966 |
| Ac-GVKINVKCKISAQCLEPCKKAGMRFGKCMNGKCHCTPK-amide | 1967 |

TABLE 7B-continued

| Additional useful OSK1 peptide analog sequences: Ala-12 Substituted Series | |
|---|---|
| Sequence/structure | SEQ ID NO: |
| GVKINVKCKISAQCLEPCKKAGMRFGKCMNGKCACTPK | 1968 |
| GVKINVKCKISAQCLKPCKDAGMRFGKCMNGKCHCTPK | 1969 |
| GVKINVKCKISAQCLKPCKDAGMRFGKCMNGKCACTPK | 1970 |
| Ac-GVKINVKCKISAQCLEPCKKAGMRFGKCMNGKCACTPK | 1971 |
| GVKINVKCKISAQCLEPCKKAGMRFGKCMNGKCACTPK-amide | 1972 |
| Ac-GVKINVKCKISAQCLEPCKKAGMRFGKCMNGKCACTPK-amide | 1973 |
| Ac-GVKINVKCKISAQCLKPCKDAGMRFGKCMNGKCACTPK | 1974 |
| GVKINVKCKISAQCLKPCKDAGMRFGKCMNGKCACTPK-amide | 1975 |
| Ac-GVKINVKCKISAQCLKPCKDAGMRFGKCMNGKCACTPK-amide | 1976 |
| Ac-GVKINVKCKISAQCLKPCKDAGMRFGKCMNGKCHCTPK | 1977 |
| GVKINVKCKISAQCLKPCKDAGMRFGKCMNGKCHCTPK-amide | 1978 |
| Ac-GVKINVKCKISAQCLKPCKDAGMRFGKCMNGKCHCTPK-amide | 1979 |
| GVIINVKCKISAQCLKPCKDAGMRFGKCMNGKCHCT | 1980 |
| GVIINVKCKISAQCLOPCKDAGMRFGKCMNGKCHCTPK | 1981 |
| GVIINVKCKISAQCL[hLys]PCKDAGMRFGKCMNGKCHCTPK | 1982 |
| GVIINVKCKISAQCL[hArg]PCKDAGMRFGKCMNGKCHCTPK | 1983 |
| GVIINVKCKISAQCL[Cit]PCKDAGMRFGKCMNGKCHCTPK | 1984 |
| GVIINVKCKISAQCL[hCit]PCKDAGMRFGKCMNGKCHCTPK | 1985 |
| GVIINVKCKISAQCL[Dpr]PCKDAGMRFGKCMNGKCHCTPK | 1986 |
| GVIINVKCKISAQCL[Dab]PCKDAGMRFGKCMNGKCHCTPK | 1987 |
| GVIINVKCKISAQCLOPCKDAGMRFGKCMNGKCHCYPK | 1988 |
| GVIINVKCKISAQCL[hLys]PCKDAGMRFGKCMNGKCHCYPK | 1989 |
| GVIINVKCKISAQCL[hArg]PCKDAGMRFGKCMNGKCHCYPK | 1990 |
| GVIINVKCKISAQCL[Cit]PCKDAGMRFGKCMNGKCHCYPK | 1991 |
| GVIINVKCKISAQCL[hCit]PCKDAGMRFGKCMNGKCHCYPK | 1992 |
| GVIINVKCKISAQCL[Dpr]PCKDAGMRFGKCMNGKCHCYPK | 1993 |
| GVIINVKCKISAQCL[Dab]PCKDAGMRFGKCMNGKCHCYPK | 1994 |
| GVIINVKCKISAQCLKPCKDAGMRFGKCMNGKCACYPK | 1995 |
| GVIINVKCKISAQCLKPCKDAGMRFGKCMNGKCGCYPK | 1996 |
| GVIINVKCKISAQCLKPCKDAGMRFGKCMNGKCACFPK | 1997 |
| GVIINVKCKISAQCLKPCKDAGMRFGKCMNGKCACWPK | 1998 |
| GVIINVKCKISAQCLKPCKEAGMRFGKCMNGKCACYPK | 1999 |
| GVIINVKCKISAQCLOPCKDAGMRFGKCMNGKCACTPK | 2000 |
| GVIINVKCKISAQCL[hLys]PCKDAGMRFGKCMNGKCACTPK | 2001 |
| GVIINVKCKISAQCL[hArg]PCKDAGMRFGKCMNGKCACTPK | 2002 |

TABLE 7B-continued

| Additional useful OSK1 peptide analog sequences: Ala-12 Substituted Series | |
|---|---|
| Sequence/structure | SEQ ID NO: |
| GVIINVKCKISAQCL[Cit]PCKDAGMRFGKCMNGKCACTPK | 2003 |
| GVIINVKCKISAQCL[hCit]PCKDAGMRFGKCMNGKCHCTPK | 2004 |
| GVIINVKCKISAQCL[Dpr]PCKDAGMRFGKCMNGKCACTPK | 2005 |
| GVIINVKCKISAQCL[Dab]PCKDAGMRFGKCMNGKCACTPK | 2006 |
| GVIINVKCKISAQCLOPCKDAGMRFGKCMNGKCHC | 2007 |
| GVIINVKCKISAQCL[hLys]PCKDAGMRFGKCMNGKCHC | 2008 |
| GVIINVKCKISAQCL[hArg]PCKDAGMRFGKCMNGKCHC | 2009 |
| GVIINVKCKISAQCL[Cit]PCKDAGMRFGKCMNGKCHC | 2010 |
| GVIINVKCKISAQCL[hCit]PCKDAGMRFGKCMNGKCHC | 2011 |
| GVIINVKCKISAQCL[Dpr]PCKDAGMRFGKCMNGKCHC | 2012 |
| GVIINVKCKISAQCL[Dab]PCKDAGMRFGKCMNGKCHC | 2013 |
| GVIINVKCKISAQCLOPCKDAGMRFGKCMNGKCAC | 2014 |
| GVIINVKCKISAQCL[hLys]PCKDAGMRFGKCMNGKCAC | 2015 |
| GVIINVKCKISAQCL[hArg]PCKDAGMRFGKCMNGKCAC | 2016 |
| GVIINVKCKISAQCL[Cit]PCKDAGMRFGKCMNGKCAC | 2017 |
| GVIINVKCKISAQCL[hCit]PCKDAGMRFGKCMNGKCHC | 2018 |
| GVIINVKCKISAQCL[Dpr]PCKDAGMRFGKCMNGKCAC | 2019 |
| GVIINVKCKISAQCL[Dab]PCKDAGMRFGKCMNGKCAC | 2020 |
| GVIINVKCKISAQCLKPCKDAGMRFGKCMNGKCGCYGG | 2021 |
| GVIINVKCKISAQCLOPCKDAGMRFGKCMNGKCHCYGG | 2022 |
| GVIINVKCKISAQCL[hLys]PCKDAGMRFGKCMNGKCHCYGG | 2023 |
| GVIINVKCKISAQCL[hArg]PCKDAGMRFGKCMNGKCHCYGG | 2024 |
| GVIINVKCKISAQCL[Cit]PCKDAGMRFGKCMNGKCHCYGG | 2025 |
| GVIINVKCKISAQCL[hCit]PCKDAGMRFGKCMNGKCHCYGG | 2026 |
| GVIINVKCKISAQCL[Dpr]PCKDAGMRFGKCMNGKCHCYGG | 2027 |
| GVIINVKCKISAQCLKPCKDAGMRFGKCMNGKCACYGG | 2028 |
| GVIINVKCKISAQCLOPCKDAGMRFGKCMNGKCACYGG | 2029 |
| GVIINVKCKISAQCL[hLys]PCKDAGMRFGKCMNGKCACYGG | 2030 |
| GVIINVKCKISAQCL[hArg]PCKDAGMRFGKCMNGKCACYGG | 2031 |
| GVIINVKCKISAQCL[Cit]PCKDAGMRFGKCMNGKCACYGG | 2032 |
| GVIINVKCKISAQCL[hCit]PCKDAGMRFGKCMNGKCHCYGG | 2033 |
| GVIINVKCKISAQCL[Dpr]PCKDAGMRFGKCMNGKCACYGG | 2034 |
| GVIINVKCKISAQCL[Dab]PCKDAGMRFGKCMNGKCACYGG | 2035 |
| GVIINVKCKISAQCLKPCKDAGMRFGKCMNGKCACYG | 2036 |
| GVIINVKCKISAQCLOPCKDAGMRFGKCMNGKCHCGGG | 2037 |
| GVIINVKCKISAQCL[hLys]PCKDAGMRFGKCMNGKCHCGGG | 2038 |

TABLE 7B-continued

Additional useful OSK1 peptide analog sequences: Ala-12 Substituted Series

| Sequence/structure | SEQ ID NO: |
|---|---|
| GVIINVKCKISAQCL[hArg]PCKDAGMRFGKCMNGKCHCGGG | 2039 |
| GVIINVKCKISAQCL[Cit]PCKDAGMRFGKCMNGKCHCGGG | 2040 |
| GVIINVKCKISAQCL[hCit]PCKDAGMRFGKCMNGKCHCGGG | 2041 |
| GVIINVKCKISAQCL[Dpr]PCKDAGMRFGKCMNGKCHCGGG | 2042 |
| GVIINVKCKISAQCLKPCKDAGMRFGKCMNGKCACFGG | 2043 |
| GVIINVKCKISAQCLOPCKDAGMRFGKCMNGKCACGGG | 2044 |
| GVIINVKCKISAQCL[hLys]PCKDAGMRFGKCMNGKCACGGG | 2045 |
| GVIINVKCKISAQCL[hArg]PCKDAGMRFGKCMNGKCACGGG | 2046 |
| GVIINVKCKISAQCL[Cit]PCKDAGMRFGKCMNGKCACGGG | 2047 |
| GVIINVKCKISAQCL[hCit]PCKDAGMRFGKCMNGKCACGGG | 2048 |
| GVIINVKCKISAQCL[Dpr]PCKDAGMRFGKCMNGKCACGGG | 2049 |
| GVIINVKCKISAQCL[Dab]PCKDAGMRFGKCMNGKCACGGG | 2050 |
| GVIINVKCKISAQCLKPCKDAGMRFGKCMNGKCACGG | 2051 |
| GVIINVKCKISAQCLKPCKDAGMRFGKCMNGKCACYG | 2052 |
| GVIINVKCKISAQCLOPCKDAGMRFGKCMNGKCACGG | 2053 |
| GVIINVKCKISAQCL[hLys]PCKEAGMRFGKCMNGKCHCTPK | 2054 |
| GVIINVKCKISAQCL[hArg]PCKEAGMRFGKCMNGKCHCTPK | 2055 |
| GVIINVKCKISAQCL[Cit]PCKEAGMRFGKCMNGKCHCTPK | 2056 |
| GVIINVKCKISAQCL[hCit]PCKEAGMRFGKCMNGKCHCTPK | 2057 |
| GVIINVKCKISAQCL[Dpr]PCKEAGMRFGKCMNGKCHCTPK | 2058 |
| GVIINVKCKISAQCL[Dab]PCKEAGMRFGKCMNGKCHCTPK | 2059 |
| GVIINVKCKISAQCLOPCKEAGMRFGKCMNGKCHCYPK | 2060 |
| GVIINVKCKISAQCL[hLys]PCKEAGMRFGKCMNGKCHCYPK | 2061 |
| GVIINVKCKISAQCL[hArg]PCKEAGMRFGKCMNGKCHCYPK | 2062 |
| GVIINVKCKISAQCL[Cit]PCKEAGMRFGKCMNGKCHCYPK | 2063 |
| GVIINVKCKISAQCL[hCit]PCKEAGMRFGKCMNGKCHCYPK | 2064 |
| GVIINVKCKISAQCL[Dpr]PCKEAGMRFGKCMNGKCHCYPK | 2065 |
| GVIINVKCKISAQCL[Dab]PCKEAGMRFGKCMNGKCHCYPK | 2066 |
| GVIINVKCKISAQCLOPCKEAGMRFGKCMNGKCACTPK | 2067 |
| GVIINVKCKISAQCL[hLys]PCKEAGMRFGKCMNGKCACTPK | 2068 |
| GVIINVKCKISAQCL[hArg]PCKEAGMRFGKCMNGKCACTPK | 2069 |
| GVIINVKCKISAQCL[Cit]PCKEAGMRFGKCMNGKCACTPK | 2070 |
| GVIINVKCKISAQCL[hCit]PCKEAGMRFGKCMNGKCHCTPK | 2071 |
| GVIINVKCKISAQCL[Dpr]PCKEAGMRFGKCMNGKCACTPK | 2072 |
| GVIINVKCKISAQCL[Dab]PCKEAGMRFGKCMNGKCACTPK | 2073 |
| GVIINVKCKISAQCLOPCKEAGMRFGKCMNGKCHC | 2074 |

TABLE 7B-continued

Additional useful OSK1 peptide analog sequences: Ala-12 Substituted Series

| Sequence/structure | SEQ ID NO: |
|---|---|
| GVIINVKCKISAQCL[hLys]PCKEAGMRFGKCMNGKCHC | 2075 |
| GVIINVKCKISAQCL[hArg]PCKEAGMRFGKCMNGKCHC | 2076 |
| GVIINVKCKISAQCL[Cit]PCKEAGMRFGKCMNGKCHC | 2077 |
| GVIINVKCKISAQCL[hCit]PCKEAGMRFGKCMNGKCHC | 2078 |
| GVIINVKCKISAQCL[Dpr]PCKEAGMRFGKCMNGKCHC | 2079 |
| GVIINVKCKISAQCLOPCKEAGMRFGKCMNGKCAC | 2080 |
| GVIINVKCKISAQCL[hLys]PCKEAGMRFGKCMNGKCAC | 2081 |
| GVIINVKCKISAQCL[hArg]PCKEAGMRFGKCMNGKCAC | 2082 |
| GVIINVKCKISAQCL[Cit]PCKEAGMRFGKCMNGKCAC | 2083 |
| GVIINVKCKISAQCL[hCit]PCKEAGMRFGKCMNGKCHC | 2084 |
| GVIINVKCKISAQCL[Dpr]PCKEAGMRFGKCMNGKCAC | 2085 |
| GVIINVKCKISAQCL[Dab]PCKEAGMRFGKCMNGKCAC | 2086 |
| GVIINVKCKISAQCLKPCKEAGMRFGKCMNGKCHCYGG | 2087 |
| GVIINVKCKISAQCLOPCKEAGMRFGKCMNGKCHCYGG | 2088 |
| GVIINVKCKISAQCLKPCKEAGMRFGKCMNGKCHCYG | 2089 |
| GVIINVKCKISAQCLKPCKEAGMRFGKCMNGKCACYG | 2090 |
| GVIINVKCKISAQCL[hLys]PCKEAGMRFGKCMNGKCHCYGG | 2091 |
| GVIINVKCKISAQCL[hArg]PCKEAGMRFGKCMNGKCHCYGG | 2092 |
| GVIINVKCKISAQCL[Cit]PCKEAGMRFGKCMNGKCHCYGG | 2093 |
| GVIINVKCKISAQCL[hCit]PCKEAGMRFGKCMNGKCHCYGG | 2094 |
| GVIINVKCKISAQCL[Dpr]PCKEAGMRFGKCMNGKCHCYGG | 2095 |
| GVIINVKCKISAQCL[Dab]PCKEAGMRFGKCMNGKCHCYGG | 2096 |
| GVIINVKCKISAQCLKPCKEAGMRFGKCMNGKCACYG | 2097 |
| GVIINVKCKISAQCLOPCKEAGMRFGKCMNGKCACYGG | 2098 |
| GVIINVKCKISAQCL[hLys]PCKEAGMRFGKCMNGKCACYGG | 2099 |
| GVIINVKCKISAQCL[hArg]PCKEAGMRFGKCMNGKCACYGG | 2100 |
| GVIINVKCKISAQCL[Cit]PCKEAGMRFGKCMNGKCACYGG | 2101 |
| GVIINVKCKISAQCL[hCit]PCKEAGMRFGKCMNGKCHCYGG | 2102 |
| GVIINVKCKISAQCL[Dpr]PCKEAGMRFGKCMNGKCACYGG | 2103 |
| GVIINVKCKISAQCL[Dab]PCKEAGMRFGKCMNGKCACYGG | 2104 |
| GVIINVKCKISAQCLKPCKEAGMRFGKCMNGKCACFGG | 2105 |
| GVIINVKCKISAQCLOPCKEAGMRFGKCMNGKCHCGGG | 2106 |
| GVIINVKCKISAQCL[hLys]PCKEAGMRFGKCMNGKCHCGGG | 2107 |
| GVIINVKCKISAQCL[hArg]PCKEAGMRFGKCMNGKCHCGGG | 2108 |
| GVIINVKCKISAQCL[Cit]PCKEAGMRFGKCMNGKCHCGGG | 2109 |
| GVIINVKCKISAQCL[hCit]PCKEAGMRFGKCMNGKCHCGGG | 2110 |

TABLE 7B-continued

Additional useful OSK1 peptide analog sequences: Ala-12 Substituted Series

| Sequence/structure | SEQ ID NO: |
|---|---|
| GVIINVKCKISAQCL[Dpr]PCKEAGMRFGKCMNGKCHCGGG | 2111 |
| GVIINVKCKISAQCLOPCKEAGMRFGKCMNGKCACGGG | 2112 |
| GVIINVKCKISAQCL[hLys]PCKEAGMRFGKCMNGKCACGGG | 2113 |
| GVIINVKCKISAQCL[hArg]PCKEAGMRFGKCMNGKCACGGG | 2114 |
| GVIINVKCKISAQCL[Cit]PCKEAGMRFGKCMNGKCACGGG | 2115 |
| GVIINVKCKISAQCL[hCit]PCKEAGMRFGKCMNGKCACTP | 2116 |
| GVIINVKCKISAQCL[Dpr]PCKEAGMRFGKCMNGKCACTP | 2117 |
| GVIINVKCKISAQCL[Dab]PCKEAGMRFGKCMNGKCACTP | 2118 |
| GVIINVKCKISAQCLOPCKDAGMRFGKCMNGKCHCTPK-amide | 2119 |
| GVIINVKCKISAQCL[hLys]PCKDAGMRFGKCMNGKCHCTPK-amide | 2120 |
| GVIINVKCKISAQCL[hArg]PCKDAGMRFGKCMNGKCHCTPK-amide | 2121 |
| GVIINVKCKISAQCL[Cit]PCKDAGMRFGKCMNGKCHCTPK-amide | 2122 |
| GVIINVKCKISAQCL[hCit]PCKDAGMRFGKCMNGKCHCTPK-amide | 2123 |
| GVIINVKCKISAQCL[Dpr]PCKDAGMRFGKCMNGKCHCTPK-amide | 2124 |
| GVIINVKCKISAQCL[Dab]PCKDAGMRFGKCMNGKCHCTPK-amide | 2125 |
| GVIINVKCKISAQCLOPCKDAGMRFGKCMNGKCHCYPK-amide | 2126 |
| GVIINVKCKISAQCL[hLys]PCKDAGMRFGKCMNGKCHCYPK-amide | 2127 |
| GVIINVKCKISAQCL[hArg]PCKDAGMRFGKCMNGKCHCYPK-amide | 2128 |
| GVIINVKCKISAQCL[Cit]PCKDAGMRFGKCMNGKCHCYPK-amide | 2129 |
| GVIINVKCKISAQCL[hCit]PCKDAGMRFGKCMNGKCHCYPK-amide | 2130 |
| GVIINVKCKISAQCL[Dpr]PCKDAGMRFGKCMNGKCHCYPK-amide | 2131 |
| GVIINVKCKISAQCL[Dab]PCKDAGMRFGKCMNGKCHCYPK-amide | 2132 |
| GVIINVKCKISAQCLOPCKDAGMRFGKCMNGKCACTPK-amide | 2133 |
| GVIINVKCKISAQCL[hLys]PCKDAGMRFGKCMNGKCACTPK-amide | 2134 |
| GVIINVKCKISAQCL[hArg]PCKDAGMRFGKCMNGKCACTPK-amide | 2135 |
| GVIINVKCKISAQCL[Cit]PCKDAGMRFGKCMNGKCACTPK-amide | 2136 |
| GVIINVKCKISAQCL[hCit]PCKDAGMRFGKCMNGKCACTPK-amide | 2137 |
| GVIINVKCKISAQCL[Dpr]PCKDAGMRFGKCMNGKCACTPK-amide | 2138 |
| GVIINVKCKISAQCL[Dab]PCKDAGMRFGKCMNGKCACTPK-amide | 2139 |
| GVIINVKCKISAQCLOPCKDAGMRFGKCMNGKCHC-amide | 2140 |
| GVIINVKCKISAQCL[hLys]PCKDAGMRFGKCMNGKCHC-amide | 2141 |
| GVIINVKCKISAQCL[hArg]PCKDAGMRFGKCMNGKCHC-amide | 2142 |
| GVIINVKCKISAQCL[Cit]PCKDAGMRFGKCMNGKCHC-amide | 2143 |
| GVIINVKCKISAQCL[hCit]PCKDAGMRFGKCMNGKCHC-amide | 2144 |
| GVIINVKCKISAQCL[Dpr]PCKDAGMRFGKCMNGKCHC-amide | 2145 |
| GVIINVKCKISAQCLOPCKDAGMRFGKCMNGKCAC-amide | 2146 |
| GVIINVKCKISAQCL[hLys]PCKDAGMRFGKCMNGKCAC-amide | 2147 |
| GVIINVKCKISAQCL[hArg]PCKDAGMRFGKCMNGKCAC-amide | 2148 |
| GVIINVKCKISAQCL[Cit]PCKDAGMRFGKCMNGKCAC-amide | 2149 |
| GVIINVKCKISAQCL[hCit]PCKDAGMRFGKCMNGKCHC-amide | 2150 |
| GVIINVKCKISAQCL[Dpr]PCKDAGMRFGKCMNGKCAC-amide | 2151 |
| GVIINVKCKISAQCL[Dab]PCKDAGMRFGKCMNGKCAC-amide | 2152 |
| GVIINVKCKISAQCLKPCKDAGMRFGKCMNGKCHCYGG-amide | 2153 |
| GVIINVKCKISAQCLOPCKDAGMRFGKCMNGKCHCYGG-amide | 2154 |
| GVIINVKCKISAQCL[hLys]PCKDAGMRFGKCMNGKCHCYGG-amide | 2155 |
| GVIINVKCKISAQCL[hArg]PCKDAGMRFGKCMNGKCHCYGG-amide | 2156 |
| GVIINVKCKISAQCL[Cit]PCKDAGMRFGKCMNGKCHCYGG-amide | 2157 |
| GVIINVKCKISAQCL[hCit]PCKDAGMRFGKCMNGKCHCYGG-amide | 2158 |
| GVIINVKCKISAQCL[Dpr]PCKDAGMRFGKCMNGKCHCYGG-amide | 2159 |
| GVIINVKCKISAQCLKPCKDAGMRFGKCMNGKCHCFGG-amide | 2160 |
| GVIINVKCKISAQCLKPCKDAGMRFGKCMNGKCHCYG-amide | 2161 |
| GVIINVKCKISAQCLKPCKDAGMRFGKCMNGKCACYG-amide | 2162 |
| GVIINVKCKISAQCLOPCKDAGMRFGKCMNGKCACYGG-amide | 2163 |
| GVIINVKCKISAQCL[hLys]PCKDAGMRFGKCMNGKCACYGG-amide | 2164 |

TABLE 7B-continued

Additional useful OSK1 peptide analog sequences: Ala-12 Substituted Series

| Sequence/structure | SEQ ID NO: |
|---|---|
| GVIINVKCKISAQCL[hArg]PCKDAGMRFGKCMNGKCACYGG-amide | 2165 |
| GVIINVKCKISAQCL[Cit]PCKDAGMRFGKCMNGKCACYGG-amide | 2166 |
| GVIINVKCKISAQCL[hCit]PCKDAGMRFGKCMNGKCACYGG-amide | 2167 |
| GVIINVKCKISAQCL[Dpr]PCKDAGMRFGKCMNGKCACYGG-amide | 2168 |
| GVIINVKCKISAQCL[Dab]PCKDAGMRFGKCMNGKCACYGG-amide | 2169 |
| GVIINVKCKISAQCLKPCKDAGMRFGKCMNGKCACYGG-amide | 2170 |
| GVIINVKCKISAQCLOPCKDAGMRFGKCMNGKCHCGGG-amide | 2171 |
| GVIINVKCKISAQCL[hLys]PCKDAGMRFGKCMNGKCHCGGG-amide | 2172 |
| GVIINVKCKISAQCL[hArg]PCKDAGMRFGKCMNGKCHCGGG-amide | 2173 |
| GVIINVKCKISAQCL[Cit]PCKDAGMRFGKCMNGKCHCGGG-amide | 2174 |
| GVIINVKCKISAQCL[hCit]PCKDAGMRFGKCMNGKCHCGGG-amide | 2175 |
| GVIINVKCKISAQCL[Dpr]PCKDAGMRFGKCMNGKCHCGGG-amide | 2176 |
| GVIINVKCKISAQCLKPCKDAGMRFGKCMNGKCACGGG-amide | 2177 |
| GVIINVKCKISAQCLOPCKDAGMRFGKCMNGKCACFGG-amide | 2178 |
| GVIINVKCKISAQCLOPCKDAGMRFGKCMNGKCACGGG-amide | 2179 |
| GVIINVKCKISAQCL[hLys]PCKDAGMRFGKCMNGKCACGGG-amide | 2180 |
| GVIINVKCKISAQCL[hArg]PCKDAGMRFGKCMNGKCACGGG-amide | 2181 |
| GVIINVKCKISAQCL[Cit]PCKDAGMRFGKCMNGKCACGGG-amide | 2182 |
| GVIINVKCKISAQCL[hCit]PCKDAGMRFGKCMNGKCACGGG-amide | 2183 |
| GVIINVKCKISAQCL[Dpr]PCKDAGMRFGKCMNGKCACGGG-amide | 2184 |
| GVIINVKCKISAQCL[Dab]PCKDAGMRFGKCMNGKCACGGG-amide | 2185 |
| GVIINVKCKISAQCLOPCKEAGMRFGKCMNGKCHCTPK-amide | 2186 |
| GVIINVKCKISAQCL[hLys]PCKEAGMRFGKCMNGKCHCTPK-amide | 2187 |
| GVIINVKCKISAQCL[hArg]PCKEAGMRFGKCMNGKCHCTPK-amide | 2188 |
| GVIINVKCKISAQCL[Cit]PCKEAGMRFGKCMNGKCHCTPK-amide | 2189 |
| GVIINVKCKISAQCL[hCit]PCKEAGMRFGKCMNGKCHCTPK-amide | 2190 |
| GVIINVKCKISAQCL[Dpr]PCKEAGMRFGKCMNGKCHCTPK-amide | 2191 |
| GVIINVKCKISAQCL[Dab]PCKEAGMRFGKCMNGKCHCTPK-amide | 2192 |
| GVIINVKCKISAQCLOPCKEAGMRFGKCMNGKCHCYPK-amide | 2193 |
| GVIINVKCKISAQCL[hLys]PCKEAGMRFGKCMNGKCHCYPK-amide | 2194 |
| GVIINVKCKISAQCL[hArg]PCKEAGMRFGKCMNGKCHCYPK-amide | 2195 |
| GVIINVKCKISAQCL[Cit]PCKEAGMRFGKCMNGKCHCYPK-amide | 2196 |
| GVIINVKCKISAQCL[hCit]PCKEAGMRFGKCMNGKCHCYPK-amide | 2197 |
| GVIINVKCKISAQCL[Dpr]PCKEAGMRFGKCMNGKCHCYPK-amide | 2198 |
| GVIINVKCKISAQCL[Dab]PCKEAGMRFGKCMNGKCHCYPK-amide | 2199 |
| GVIINVKCKISAQCLOPCKEAGMRFGKCMNGKCACTPK-amide | 2200 |
| GVIINVKCKISAQCL[hLys]PCKEAGMRFGKCMNGKCACTPK-amide | 2201 |
| GVIINVKCKISAQCL[hArg]PCKEAGMRFGKCMNGKCACTPK-amide | 2202 |
| GVIINVKCKISAQCL[Cit]PCKEAGMRFGKCMNGKCACTPK-amide | 2203 |
| GVIINVKCKISAQCL[hCit]PCKEAGMRFGKCMNGKCACTPK-amide | 2204 |
| GVIINVKCKISAQCL[Dpr]PCKEAGMRFGKCMNGKCACTPK-amide | 2205 |
| GVIINVKCKISAQCL[Dab]PCKEAGMRFGKCMNGKCACTPK-amide | 2206 |
| GVIINVKCKISAQCLOPCKEAGMRFGKCMNGKCHC-amide | 2207 |
| GVIINVKCKISAQCL[hLys]PCKEAGMRFGKCMNGKCHC-amide | 2208 |
| GVIINVKCKISAQCL[hArg]PCKEAGMRFGKCMNGKCHC-amide | 2209 |
| GVIINVKCKISAQCL[Cit]PCKEAGMRFGKCMNGKCHC-amide | 2210 |
| GVIINVKCKISAQCL[hCit]PCKEAGMRFGKCMNGKCHC-amide | 2211 |
| GVIINVKCKISAQCL[Dpr]PCKEAGMRFGKCMNGKCHC-amide | 2212 |
| GVIINVKCKISAQCLOPCKEAGMRFGKCMNGKCAC-amide | 2213 |
| GVIINVKCKISAQCL[hLys]PCKEAGMRFGKCMNGKCAC-amide | 2214 |
| GVIINVKCKISAQCL[hArg]PCKEAGMRFGKCMNGKCAC-amide | 2215 |

TABLE 7B-continued

| Additional useful OSK1 peptide analog sequences: Ala-12 Substituted Series | |
|---|---|
| Sequence/structure | SEQ ID NO: |
| GVIINVKCKISAQCL[Cit]PCKEAGMRFGKCMNGKCAC-amide | 2216 |
| GVIINVKCKISAQCL[hCit]PCKEAGMRFGKCMNGKCHC-amnide | 2217 |
| GVIINVKCKISAQCL[Dpr]PCKEAGMRFGKCMNGKCAC-amide | 2218 |
| GVIINVKCKISAQCL[Dab]PCKEAGMRFGKCMNGKCAC-amide | 2219 |
| GVIINVKCKISAQCLKPCKEAGMRFGKCMNGKCHCWGG-amide | 2220 |
| GVIINVKCKISAQCLOPCKEAGMRFGKCMNGKCHCYGG-amide | 2221 |
| GVIINVKCKISAQCL[hLys]PCKEAGMRFGKCMNGKCHCYGG-amide | 2222 |
| GVIINVKCKISAQCL[hArg]PCKEAGMRFGKCMNGKCHCYGG-amide | 2223 |
| GVIINVKCKISAQCL[Cit]PCKEAGMRFGKCMNGKCHCYGG-amide | 2224 |
| GVIINVKCKISAQCL[hCit]PCKEAGMRFGKCMNGKCHCYGG-amide | 2225 |
| GVIINVKCKISAQCL[Dpr]PCKEAGMRFGKCMNGKCHCYGG-amide | 2226 |
| GVIINVKCKISAQCL[Dab]PCKEAGMRFGKCMNGKCHCYGG-amide | 2227 |
| GVIINVKCKISAQCLKPCKEAGMRFGKCMNGKCACYGG-amide | 2228 |
| GVIINVKCKISAQCLOPCKEAGMRFGKCMNGKCACYGG-amide | 2229 |
| GVIINVKCKISAQCL[hLys]PCKEAGMRFGKCMNGKCACYGG-amide | 2230 |
| GVIINVKCKISAQCL[hArg]PCKEAGMRFGKCMNGKCACYGG-amide | 2231 |
| GVIINVKCKISAQCL[Cit]PCKEAGMRFGKCMNGKCACYGG-amide | 2232 |
| GVIINVKCKISAQCL[hCit]PCKEAGMRFGKCMNGKCHCYGG-amide | 2233 |
| GVIINVKCKISAQCL[Dpr]PCKEAGMRFGKCMNGKCACYGG-amide | 2234 |
| GVIINVKCKISAQCL[Dab]PCKEAGMRFGKCMNGKCACYGG-amide | 2235 |
| GVIINVKCKISAQCLOPCKEAGMRFGKCMNGKCHCGGG-amide | 2236 |
| GVIINVKCKISAQCL[hLys]PCKEAGMRFGKCMNGKCHCGGG-amide | 2237 |
| GVIINVKCKISAQCL[hArg]PCKEAGMRFGKCMNGKCHCGGG-amide | 2238 |
| GVIINVKCKISAQCL[Cit]PCKEAGMRFGKCMNGKCHCGGG-amide | 2239 |
| GVIINVKCKISAQCL[hCit]PCKEAGMRFGKCMNGKCHCGGG-amide | 2240 |
| GVIINVKCKISAQCL[Dpr]PCKEAGMRFGKCMNGKCHCGGG-amide | 2241 |

TABLE 7B-continued

| Additional useful OSK1 peptide analog sequences: Ala-12 Substituted Series | |
|---|---|
| Sequence/structure | SEQ ID NO: |
| GVIINVKCKISAQCLOPCKEAGMRFGKCMNGKCACGGG-amide | 2242 |
| GVIINVKCKISAQCL[hLys]PCKEAGMRFGKCMNGKCACGGG-amide | 2243 |
| GVIINVKCKISAQCL[hArg]PCKEAGMRFGKCMNGKCACGGG-amide | 2244 |
| GVIINVKCKISAQCL[Cit]PCKEAGMRFGKCMNGKCACGGG-amide | 2245 |
| GVIINVKCKISAQCL[hCit]PCKEAGMRFGKCMNGKCACTP-amide | 2246 |
| GVIINVKCKISAQCL[Dpr]PCKEAGMRFGKCMNGKCACGGG-amide | 2247 |
| GVIINVKCKISAQCL[Dab]PCKEAGMRFGKCMNGKCACGGG-amide | 2248 |
| GVIINVKCKISAQCLKPCK[Cpa]AGMRFGKCMNGKCACYGG-amide | 2249 |
| GVIINVKCKISAQCLKPCK[Cpa]AGMRFGKCMNGKCACGGG-amide | 2250 |
| GVIINVKCKISAQCLKPCK[Cpa]AGMRFGKCMNGKCACY-amide | 2251 |
| Ac-GVIINVKCKISAQCLKPCKDAGMRFGKCMNGKCACYGG-amide | 2252 |
| GVIINVKCKISAQCLKPCK[Aad]AGMRFGKCMNGKCACYGG-amide | 2253 |
| GVIINVKCKISAQCLKPCK[Aad]AGMRFGKCMNGKCHCYGG-amide | 2254 |
| GVIINVKCKISAQCLKPCK[Aad]AGMRFGKCMNGKCACYGG | 2255 |
| GVIINVKCKISAQCLHPCKDAGMRFGKCMNGKCACYGG-amide | 2256 |
| GVIINVKCKISAQCLHPCKDAGMRFGKCMNGKCACYGG | 2257 |
| GVIINVKCKISAQCLHPCKDAGMRFGKCMNGKCACY-amide | 2258 |
| GVIINVKCKISAQCLHPCKDAGMRFGKCMNGKCHCYGG-amicie | 2259 |
| GVIINVKCKISAQCLHPCKDAGMRFGKCMNGKCHCYGG | 2260 |
| GVIINVKCKISAQCLHPCKDAGMRFGKCMNGKCHCYPK | 2261 |
| GVIINVKCKISAQCLHPCKDAGMRFGKCMNGKCAC | 2262 |
| GVIINVKCKISAQCLKPCKDAGMRFGKCMNGKCAC[1Nal]GG-amide | 2263 |
| GVIINVKCKISAQCLKPCKDAGMRFGKCMNGKCAC[1Nal]PK-amide | 2264 |
| GVIINVKCKISAQCLKPCKDAGMRFGKCMNGKCAC[2Nal]GG-amide | 2265 |
| GVIINVKCKISAQCLKPCKDAGMRFGKCMNGKCAC[Cha]GG-amide | 2266 |
| GVIINVKCKISAQCLKPCKDAGMRFGKCMNGKCAC[MePhe]GG-amide | 2267 |

TABLE 7B-continued

Additional useful OSK1 peptide analog sequences: Ala-12 Substituted Series

| Sequence/structure | SEQ ID NO: |
|---|---|
| GVIINVKCKISAQCLKPCKDAGMRFGKCMNGKCAC[BiPhA]GG-amide | 2268 |
| GVIINVKCKISAQCLKPCKDAGMRFGKCMNGKC[Aib]CYGG-amide | 2269 |
| GVIINVKCKISAQCLKPCKDAGMRFGKCMNGKC[Abu]CYGG-amide | 2270 |
| GVIINVKCKISAQCLKPCKDAGMRFGKCMNGKCAC[1Nal] | 2271 |
| GVIINVKCKISAQCLHPCKDAGMRFGKCMNGKCAC[1Nal]GG-amide | 2272 |
| GVIINVKCKISAQCLKPCKDAGMRFGKCMNGKCAC[4Bip]-amide | 2273 |
| GVIINVKCKISAQCLHPCKDAGMRFGKCMNGKCAC[4Bip]GG-amide | 2274 |
| GVIINVKCKISAQCLKPCKDAGMRFGKCMNGKCHCGGG | 2275 |

TABLE 7C

Additional useful OSK1 peptide analog sequences: Ala-12 & Ala27 Substituted Series

| Sequence/structure | SEQ ID NO: |
|---|---|
| GVIINVKCKISAQCLEPCKKAGMRFGACMNGKCHCTPK | 2276 |
| GVIINVSCKISAQCLEPCKKAGMRFGACMNGKCHCTPK | 2277 |
| GVIINVKCKISAQCLKPCKKAGMRFGACMNGKCHCTPK | 2278 |
| GVIINVKCKISAQCLEPCKDAGMRFGACMNGKCHCTPK | 2279 |
| GVIINVKCKISAQCLKPCKDAGMRFGACMNGKCHCTPK | 2280 |
| GVIINVSCKISAQCLKPCKDAGMRFGACMNGKCHCTPK | 2281 |
| GVIINVKCKISPQCLKPCKDAGMRFGACMNGKCHCTPK | 2282 |
| GVIINVKCKISAQCLKPCKDAGMRFGACMNGKCHCYPK | 2283 |
| Ac-GVIINVKCKISPQCLKPCKDAGMRFGACMNGKCHCTPK | 2284 |
| GVIINVKCKISPQCLKPCKDAGMRFGACMNGKCHCTPK-amide | 2285 |
| Ac-GVIINVKCKISPQCLKPCKDAGMRFGACMNGKCHCTPK-amide | 2286 |
| GVIINVKCKISAQCLKPCKDAGMRFGACMNGKCHCYPK-amide | 2287 |
| Ac-GVIINVKCKISAQCLKPCKDAGMRFGACMNGKCHCYPK | 2288 |
| Ac-GVIINVKCKISAQCLKPCKDAGMRFGACMNGKCHCYPK-amide | 2289 |
| GVIINVKCKISAQCLKPCKKAGMRFGACMNGKCHCTPK-amide | 2290 |
| Ac-GVIINVKCKISAQCLKPCKKAGMRFGACMNGKCHCTPK | 2291 |
| Ac-GVIINVKCKISAQCLKPCKKAGMRFGACMNGKCHCTPK-amide | 2292 |

TABLE 7C-continued

Additional useful OSK1 peptide analog sequences: Ala-12 & Ala27 Substituted Series

| Sequence/structure | SEQ ID NO: |
|---|---|
| Ac-GVIINVKCKISAQCLEPCKDAGMRFGACMNGKCHCTPK | 2293 |
| GVIINVKCKISAQCLEPCKDAGMRFGACMNGKCHCTPK-amide | 2294 |
| Ac-GVIINVKCKISAQCLEPCKDAGMRFGACMNGKCHCTPK-amide | 2295 |
| GVIINVKCKISAQCLEPCKKAGMRFGACMNGKCHCTPK-amide | 2296 |
| Ac-GVIINVKCKISAQCLEPCKKAGMRFGACMNGKCHCTPK | 2297 |
| Ac-GVIINVKCKISAQCLEPCKKAGMRFGACMNGKCHCTPK-amide | 2298 |
| GVIINVKCKISAQCLKPCKDAGMRFGACMNGKCHCTPK-amide | 2299 |
| Ac-GVIINVKCKISAQCLKPCKDAGMRFGACMNGKCHCTPK | 2300 |
| Ac-GVIINVKCKISAQCLKPCKDAGMRFGACMNGKCHCTPK-amide | 2301 |
| VIINVKCKISAQCLEPCKKAGMRFGACMNGKCHCTPK | 2302 |
| Ac-VIINVKCKISAQCLEPCKKAGMRFGACMNGKCHCTPK | 2303 |
| VIINVKCKISAQCLEPCKKAGMRFGACMNGKCHCTPK-amide | 2304 |
| Ac-VIINVKCKISAQCLEPCKKAGMRFGACMNGKCHCTPK-amide | 2305 |
| GVIINVKCKISAQCLEPCKKAGMRFGACMNGKCACTPK | 2306 |
| Ac-GVIINVKCKISAQCLEPCKKAGMRFGACMNGKCACTPK | 2307 |
| GVIINVKCKISAQCLEPCKKAGMRFGACMNGKCACTPK-amide | 2308 |
| Ac-GVIINVKCKISAQCLEPCKKAGMRFGACMNGKCACTPK-amide | 2309 |
| VIINVKCKISAQCLKPCKDAGMRFGACMNGKCHCTPK | 2310 |
| Ac-VIINVKCKISAQCLKPCKDAGMRFGACMNGKCHCTPK | 2311 |
| VIINVKCKISAQCLKPCKDAGMRFGACMNGKCHCTPK-amide | 2312 |
| Ac-VIINVKCKISAQCLKPCKDAGMRFGACMNGKCHCTPK-amide | 2313 |
| NVKCKISAQCLKPCKDAGMRFGACMNGKCHCTPK | 2314 |
| Ac-NVKCKISAQCLKPCKDAGMRFGACMNGKCHCTPK | 2315 |
| NVKCKISAQCLKPCKDAGMRFGACMNGKCHCTPK-amide | 2316 |
| Ac-NVKCKISAQCLKPCKDAGMRFGACMNGKCHCTPK-amide | 2317 |
| KCKISAQCLKPCKDAGMRFGACMNGKCHCTPK | 2318 |
| Ac-KCKISAQCLKPCKDAGMRFGACMNGKCHCTPK | 2319 |
| KCKISAQCLKPCKDAGMRFGACMNGKCHCTPK-amide | 2320 |
| Ac-KCKISAQCLKPCKDAGMRFGACMNGKCHCTPK-amide | 2321 |
| CKISAQCLKPCKDAGMRFGACMNGKCHCTPK | 2322 |
| Ac-CKISAQCLKPCKDAGMRFGACMNGKCHCTPK | 2323 |
| CKISAQCLKPCKDAGMRFGACMNGKCHCTPK-amide | 2324 |
| Ac-CKISAQCLKPCKDAGMRFGACMNGKCHCTPK-amide | 2325 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCLKPCKDAGMRNGACMNGKCHCTPK | 2326 |
| GVIINVKCKISAQCLKPCKDAGMRNGACMNGKCHCTPK-amide | 2327 |
| Ac-GVIINVKCKISAQCLKPCKDAGMRNGACMNGKCHCTPK | 2328 |
| Ac-GVIINVKCKISAQCLKPCKDAGMRNGACMNGKCHCTPK-amide | 2329 |
| GVIINVKCKISAQCLKPCKDAGMRFGKCMNRKCHCTPK | 2330 |
| GVIINVKCKISAQCLKPCKDAGMRFGKCMNRKCHCTPK-amide | 2331 |
| Ac-GVIINVKCKISAQCLKPCKDAGMRFGKCMNRKCHCTPK | 2332 |
| Ac-GVIINVKCKISAQCLKPCKDAGMRFGKCMNRKCHCTPK-amide | 2333 |
| GVIINVKCKISKQCLKPCRDAGMRFGACMNGKCHCTPK | 2334 |
| Ac-GVIINVKCKISKQCLKPCRDAGMRFGACMNGKCHCTPK | 2335 |
| GVIINVKCKISKQCLKPCGDAGMRFGACMNGKCHCTPK-amide | 2336 |
| Ac-GVIINVKCKISKQCLKPCRDAGMRFGACMNGKCHCTPK-amide | 2337 |
| TIINVKCKISAQCLKPCKDAGMRFGACMNGKCHCTPK | 2338 |
| Ac-TIINVKCKISAQCLKPCKDAGMRFGACMNGKCHCTPK | 2339 |
| TIINVKCKISAQCLKPCKDAGMRFGACMNGKCHCTPK-amide | 2340 |
| Ac-TIINVKCKISAQCLKPCKDAGMRFGACMNGKCHCTPK-amide | 2341 |
| GVKINVKCKISAQCLEPCKKAGMRFGACMNGKCHCTPK | 2342 |
| Ac-GVKINVKCKISAQCLEPCKKAGMRFGACMNGKCHCTPK | 2343 |
| GVKINVKCKISAQCLEPCKKAGMRFGACMNGKCHCTPK-amide | 2344 |
| Ac-GVKINVKCKISAQCLEPCKKAGMRFGACMNGKCHCTPK-amide | 2345 |
| GVKINVKCKISAQCLEPCKKAGMRFGACMNGKCACTPK | 2346 |
| GVKINVKCKISAQCLKPCKDAGMRFGACMNGKCHCTPK | 2347 |
| GVKINVKCKISAQCLKPCKDAGMRFGACMNGKCACTPK | 2348 |
| Ac-GVKINVKCKISAQCLEPCKKAGMRFGACMNGKCACTPK | 2349 |
| GVKINVKCKISAQCLEPCKKAGMRFGACMNGKCACTPK-amide | 2350 |
| Ac-GVKINVKCKISAQCLEPCKKAGMRFGACMNGKCACTPK-amide | 2351 |
| Ac-GVKINVKCKISAQCLKPCKDAGMRFGACMNGKCACTPK | 2352 |
| GVKINVKCKISAQCLKPCKDAGMRFGACMNGKCACTPK-amide | 2353 |
| Ac-GVKINVKCKISAQCLKPCKDAGMRFGACMNGKCACTPK-amide | 2354 |
| Ac-GVKINVKCKISAQCLKPCKDAGMRFGACMNGKCHCTPK | 2355 |
| GVKINVKCKISAQCLKPCKDAGMRFGACMNGKCHCTPK-amide | 2356 |
| Ac-GVKINVKCKISAQCLKPCKDAGMRFGACMNGKCHCTPK-amide | 2357 |
| GVIINVKCKISAQCLKPCKDAGMRFGACMNGKCHCT | 2358 |
| GVIINVKCKISAQCLOPCKDAGMRFGACMNGKCHCTPK | 2359 |
| GVIINVKCKISAQCL[hLys]PCKDAGMRFGACMNGKCHCTPK | 2360 |
| GVIINVKCKISAQCL[hArg]PCKDAGMRFGACMNGKCHCTPK | 2361 |
| GVIINVKCKISAQCL[Cit]PCKDAGMRFGACMNGKCHCTPK | 2362 |
| GVIINVKCKISAQCL[hCit]PCKDAGMRFGACMNGKCHCTPK | 2363 |
| GVIINVKCKISAQCL[Dpr]PCKDAGMRFGACMNGKCHCTPK | 2364 |
| GVIINVKCKISAQCL[Dab]PCKDAGMRFGACMNGKCHCTPK | 2365 |
| GVIINVKCKISAQCLOPCKDAGMRFGACMNGKCHCYPK | 2366 |
| GVIINVKCKISAQCL[hLys]PCKDAGMRFGACMNGKCHCYPK | 2367 |
| GVIINVKCKISAQCL[hArg]PCKDAGMRFGACMNGKCHCYPK | 2368 |
| GVIINVKCKISAQCL[Cit]PCKDAGMRFGACMNGKCHCYPK | 2369 |
| GVIINVKCKISAQCL[hCit]PCKDAGMRFGACMNGKCHCYPK | 2370 |
| GVIINVKCKISAQCL[Dpr]PCKDAGMRFGACMNGKCHCYPK | 2371 |
| GVIINVKCKISAQCL[Dab]PCKDAGMRFGACMNGKCHCYPK | 2372 |
| GVIINVKCKISAQCLKPCKDAGMRFGACMNGKCACYPK | 2373 |
| GVIINVKCKISAQCLKPCKDAGMRFGACMNGKCGCYPK | 2374 |
| GVIINVKCKISAQCLKPCKDAGMRFGACMNGKCACFPK | 2375 |
| GVIINVKCKISAQCLKPCKDAGMRFGACMNGKCACWPK | 2376 |
| GVIINVKCKISAQCLKPCKEAGMRFGACMNGKCACYPK | 2377 |
| GVIINVKCKISAQCLOPCKDAGMRFGACMNGKCACTPK | 2378 |
| GVIINVKCKISAQCL[hLys]PCKDAGMRFGACMNGKCACTPK | 2379 |
| GVIINVKCKISAQCL[hArg]PCKDAGMRFGACMNGKCACTPK | 2380 |
| GVIINVKCKISAQCL[Cit]PCKDAGMRFGACMNGKCACTPK | 2381 |
| GVIINVKCKISAQCL[hCit]PCKDAGMRFGACMNGKCHCTPK | 2382 |
| GVIINVKCKISAQCL[Dpr]PCKDAGMRFGACMNGKCACTPK | 2383 |
| GVIINVKCKISAQCL[Dab]PCKDAGMRFGACMNGKCACTPK | 2384 |
| GVIINVKCKISAQCLOPCKDAGMRFGACMNGKCHC | 2385 |
| GVIINVKCKISAQCL[hLys]PCKDAGMRFGACMNGKCHC | 2386 |
| GVIINVKCKISAQCL[hArg]PCKDAGMRFGACMNGKCHC | 2387 |
| GVIINVKCKISAQCL[Cit]PCKDAGMRFGACMNGKCHC | 2388 |
| GVIINVKCKISAQCL[hCit]PCKDAGMRFGACMNGKCHC | 2389 |
| GVIINVKCKISAQCL[Dpr]PCKDAGMRFGACMNGKCHC | 2390 |
| GVIINVKCKISAQCL[Dab]PCKDAGMRFGACMNGKCHC | 2391 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCLOPCKDAGMRFGACMNGKCAC | 2392 |
| GVIINVKCKISAQCL[hLys]PCKDAGMRFGACMNGKCAC | 2393 |
| GVIINVKCKISAQCL[hArg]PCKDAGMRFGACMNGKCAC | 2394 |
| GVIINVKCKTTAQCL[Cit]PCKDAGMRFGACMNGKCAC | 2395 |
| GVIINVKCKISAQCL[hCit]PCKDAGMRFGACMNGKCHC | 2396 |
| GVIINVKCKISAQCL[Dpr]PCKDAGMRFGACMNGKCAC | 2397 |
| GVIINVKCKISAQCL[Dab]PCKDAGMRFGACMNGKCAC | 2398 |
| GVIINVKCKISAQCLKPCKDAGMRFGACMNGKCGCYGG | 2399 |
| GVIINVKCKISAQCLOPCKDAGMRFGACMNGKCHCYGG | 2400 |
| GVIINVKCKISAQCL[hLys]PCKDAGMRFGACMNGKCHCYGG | 2401 |
| GVIINVKCKISAQCL[hArg]PCKDAGMRFGACMNGKCHCYGG | 2402 |
| GVIINVKCKISAQCL[Cit]PCKDAGMRFGACMNGKCHCYGG | 2403 |
| GVIINVKCKISAQCL[hCit]PCKDAGMRFGACMNGKCHCYGG | 2404 |
| GVIINVKCKISAQCL[Dpr]PCKDAGMRFGACMNGKCHCYGG | 2405 |
| GVIINVKCKISAQCLKPCKDAGMRFGACMNGKCACYGG | 2406 |
| GVIINVKCKISAQCLOPCKDAGMRFGACMNGKCACYGG | 2407 |
| GVIINVKCKISAQCL[hLys]PCKDAGMRFGACMNGKCACYGG | 2408 |
| GVIINVKCKISAQCL[hArg]PCKDAGMRFGACMNGKCACYGG | 2409 |
| GVIINVKCKISAQCL[Cit]PCKDAGMRFGACMNGKCACYGG | 2410 |
| GVIINVKCKISAQCL[hCit]PCKDAGMRFGACMNGKCHCYGG | 2411 |
| GVIINVKCKISAQCL[Dpr]PCKDAGMRFGACMNGKCACYGG | 2412 |
| GVIINVKCKISAQCL[Dab]PCKDAGMRFGACMNGKCACYGG | 2413 |
| GVIINVKCKISAQCLKPCKDAGMRFGACMNGKCACYG | 2415 |
| GVIINVKCKISAQCLOPCKDAGMRFGACMNGKCHCGGG | 2416 |
| GVIINVKCKISAQCL[hLys]PCKDAGMRFGACMNGKCHCGGG | 2417 |
| GVIINVKCKISAQCL[hArg]PCKDAGMRFGACMNGKCHCGGG | 2418 |
| GVIINVKCKISAQCL[Cit]PCKDAGMRFGACMNGKCHCGGG | 2419 |
| GVIINVKCKISAQCL[hCit]PCKDAGMRFGACMNGKCHCGGG | 2420 |
| GVIINVKCKISAQCL[Dpr]PCKDAGMRFGACMNGKCHCGGG | 2421 |
| GVIINVKCKISAQCLKPCKDAGMRFGACMNGKCACFGG | 2422 |
| GVIINVKCKISAQCLOPCKDAGMRFGACMNGKCACGGG | 2423 |
| GVIINVKCKISAQCL[hLys]PCKDAGMRFGACMNGKCACGGG | 2424 |
| GVIINVKCKISAQCL[hArg]PCKDAGMRFGACMNGKCACGGG | 2425 |
| GVIINVKCKISAQCL[Cit]PCKDAGMRFGACMNGKCACGGG | 2426 |
| GVIINVKCKISAQCL[hCit]PCKDAGMRFGACMNGKCACGGG | 2427 |
| GVIINVKCKISAQCL[Dpr]PCKDAGMRFGACMNGKCACGGG | 2428 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCL[Dab]PCKDAGMRFGACMNGKCACGGG | 2429 |
| GVIINVKCKISAQCLKPCKDAGMRFGACMNGKCACGG | 2430 |
| GVIINVKCKISAQCLKPCKDAGMRFGACMNGKCACYG | 2431 |
| GVIINVKCKISAQCLOPCKDAGMRFGACMNGKCACGG | 2432 |
| GVIINVKCKISAQCL[hLys]PCKEAGMRFGACMNGKCHCTPK | 2433 |
| GVIINVKCKISAQCL[hArg]PCKEAGMRFGACMNGKCHCTPK | 2434 |
| GVIINVKCKISAQCL[Cit]PCKEAGMRFGACMNGKCHCTPK | 2435 |
| GVIINVKCKISAQCL[hCit]PCKEAGMRFGACMNGKCHCTPK | 2436 |
| GVIINVKCKISAQCL[Dpr]PCKEAGMRFGACMNGKCHCTPK | 2437 |
| GVIINVKCKISAQCL[Dab]PCKEAGMRFGACMNGKCHCTPK | 2438 |
| GVIINVKCKISAQCLOPCKEAGMRFGACMNGKCHCYPK | 2439 |
| GVIINVKCKISAQCL[hLys]PCKEAGMRFGACMNGKCHCYPK | 2440 |
| GVIINVKCKISAQCL[hArg]PCKEAGMRFGACMNGKCHCYPK | 2441 |
| GVIINVKCKISAQCL[Cit]PCKEAGMRFGACMNGKCHCYPK | 2442 |
| GVIINVKCKISAQCL[hCit]PCKEAGMRFGACMNGKCHCYPK | 2443 |
| GVIINVKCKISAQCL[Dpr]PCKEAGMRFGACMNGKCHCYPK | 2444 |
| GVIINVKCKISAQCL[Dab]PCKEAGMRFGACMNGKCHCYPK | 2445 |
| GVIINVKCKISAQCLOPCKEAGMRFGACMNGKCACTPK | 2446 |
| GVIINVKCKISAQCL[hLys]PCKEAGMRFGACMNGKCACTPK | 2447 |
| GVIINVKCKISAQCL[hArg]PCKEAGMRFGACMNGKCACTPK | 2448 |
| GVIINVKCKISAQCL[Cit]PCKEAGMRFGACMNGKCACTPK | 2449 |
| GVIINVKCKISAQCL[hCit]PCKEAGMRFGACMNGKCHCTPK | 2450 |
| GVIINVKCKISAQCL[Dpr]PCKEAGMRFGACMNGKCACTPK | 2451 |
| GVIINVKCKISAQCL[Dab]PCKEAGMRFGACMNGKCACTPK | 2452 |
| GVIINVKCKISAQCLOPCKEAGMRFGACMNGKCHC | 2453 |
| GVIINVKCKISAQCL[hLys]PCKEAGMRFGACMNGKCHC | 2454 |
| GVIINVKCKISAQCL[hArg]PCKEAGMRFGACMNGKCHC | 2455 |
| GVIINVKCKISAQCL[Cit]PCKEAGMRFGACMNGKCHC | 2456 |
| GVIINVKCKISAQCL[hCit]PCKEAGMRFGACMNGKCHC | 2457 |
| GVIINVKCKISAQCL[Dpr]PCKEAGMRFGACMNGKCHC | 2458 |
| GVIINVKCKISAQCLOPCKEAGMRFGACMNGKCAC | 2459 |
| GVIINVKCKISAQCL[hLys]PCKEAGMRFGACMNGKCAC | 2460 |
| GVIINVKCKISAQCL[hArg]PCKEAGMRFGACMNGKCAC | 2461 |
| GVIINVKCKISAQCL[Cit]PCKEAGMRFGACMNGKCAC | 2462 |
| GVIINVKCKISAQCL[hCit]PCKEAGMRFGACMNGKCHC | 2463 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCL[Dpr]PCKEAGMRFGACMNGKCAC | 2464 |
| GVIINVKCKISAQCL[Dab]PCKEAGMRFGACMNGKCAC | 2465 |
| GVIINVKCKISAQCLKPCKEAGMRFGACMNGKCHCYGG | 2466 |
| GVIINVKCKISAQCLOPCKEAGMRFGACMNGKCHCYGG | 2467 |
| GVIINVKCKISAQCLKPCKEAGMRFGACMNGKCHCYG | 2468 |
| GVIINVKCKISAQCLKPCKEAGMRFGACMNGKCACYG | 2469 |
| GVIINVKCKISAQCL[hLys]PCKEAGMRFGACMNGKCHCYGG | 2470 |
| GVIINVKCKISAQCL[hArg]PCKEAGMRFGACMNGKCHCYGG | 2471 |
| GVIINVKCKISAQCL[Cit]PCKEAGMRFGACMNGKCHCYGG | 2472 |
| GVIINVKCKISAQCL[hCit]PCKEAGMRFGACMNGKCHCYGG | 2473 |
| GVIINVKCKISAQCL[Dpr]PCKEAGMRFGACMNGKCHCYGG | 2474 |
| GVIINVKCKISAQCL[Dab]PCKEAGMRFGACMNGKCHCYGG | 2475 |
| GVIINVKCKISAQCLKPCKEAGMRFGACMNGKCACYG | 2476 |
| GVIINVKCKISAQCLOPCKEAGMRFGACMNGKCACYGG | 2477 |
| GVIINVKCKISAQCL[hLys]PCKEAGMRFGACMNGKCACYGG | 2478 |
| GVIINVKCKISAQCL[hArg]PCKEAGMRFGACMNGKCACYGG | 2479 |
| GVIINVKCKISAQCL[Cit]PCKEAGMRFGACMNGKCACYGG | 2480 |
| GVIINVKCKISAQCL[hCit]PCKEAGMRFGACMNGKCHCYGG | 2481 |
| GVIINVKCKISAQCL[Dpr]PCKEAGMRFGACMNGKCACYGG | 2482 |
| GVIINVKCKISAQCL[Dab]PCKEAGMRFGACMNGKCACYGG | 2483 |
| GVIINVKCKISAQCLKPCKEAGMRFGACMNGKCACFGG | 2484 |
| GVIINVKCKISAQCLOPCKEAGMRFGACMNGKCHCGGG | 2485 |
| GVIINVKCKISAQCL[hLys]PCKEAGMRFGACMNGKCHCGGG | 2486 |
| GVIINVKCKISAQCL[hArg]PCKEAGMRFGACMNGKCHCGGG | 2487 |
| GVIINVKCKISAQCL[Cit]PCKEAGMRFGACMNGKCHCGGG | 2488 |
| GVIINVKCKISAQCL[hCit]PCKEAGMRFGACMNGKCHCGGG | 2489 |
| GVIINVKCKISAQCL[Dpr]PCKEAGMRFGACMNGKCHCGGG | 2490 |
| GVIINVKCKISAQCLOPCKEAGMRFGACMNGKCACGGG | 2491 |
| GVIINVKCKISAQCL[hLys]PCKEAGMRFGACMNGKCACGGG | 2492 |
| GVIINVKCKISAQCL[hArg]PCKEAGMRFGACMNGKCACGGG | 2493 |
| GVIINVKCKISAQCL[Cit]PCKEAGMRFGACMNGKCACGGG | 2494 |
| GVIINVKCKISAQCL[hCit]PCKEAGMRFGACMNGKCACTP | 2495 |
| GVIINVKCKISAQCL[Dpr]PCKEAGMRFGACMNGKCACTP | 2496 |
| GVIINVKCKISAQCL[Dab]PCKEAGMRFGACMNGKCACTP | 2497 |
| GVIINVKCKISAQCLOPCKDAGMRFGACMNGKCHCTPK-amide | 2498 |
| GVIINVKCKISAQCL[hLys]PCKDAGMRFGACMNGKCHCTPK-amide | 2499 |
| GVIINVKCKISAQCL[hArg]PCKDAGMRFGACMNGKCHCTPK-amide | 2500 |
| GVIINVKCKISAQCL[Cit]PCKDAGMRFGACMNGKCHCTPK-amide | 2501 |
| GVIINVKCKISAQCL[hCit]PCKDAGMRFGACMNGKCHCTPK-amide | 2502 |
| GVIINVKCKISAQCL[Dpr]PCKDAGMRFGACMNGKCHCTPK-amide | 2503 |
| GVIINVKCKISAQCL[Dab]PCKDAGMRFGACMNGKCHCTPK-amide | 2504 |
| GVIINVKCKISAQCLOPCKDAGMRFGACMNGKCHCYPK-amide | 2505 |
| GVIINVKCKISAQCL[hLys]PCKDAGMRFGACMNGKCHCYPK-amide | 2506 |
| GVIINVKCKISAQCL[hArg]PCKDAGMRFGACMNGKCHCYPK-amide | 2507 |
| GVIINVKCKISAQCL[Cit]PCKDAGMRFGACMNGKCHCYPK-amide | 2508 |
| GVIINVKCKISAQCL[hCit]PCKDAGMRFGACMNGKCHCYPK-amide | 2509 |
| GVIINVKCKISAQCL[Dpr]PCKDAGMRFGACMNGKCHCYPK-amide | 2510 |
| GVIINVKCKISAQCL[Dab]PCKDAGMRFGACMNGKCHCYPK-amide | 2511 |
| GVIINVKCKISAQCLOPCKDAGMRFGACMNGKCACTPK-amide | 2512 |
| GVIINVKCKISAQCL[hLys]PCKDAGMRFGACMNGKCACTPK-amide | 2513 |
| GVIINVKCKISAQCL[hArg]PCKDAGMRFGACMNGKCACTPK-amide | 2514 |
| GVIINVKCKISAQCL[Cit]PCKDAGMRFGACMNGKCACTPK-amide | 2515 |
| GVIINVKCKISAQCL[hCit]PCKDAGMRFGACMNGKCACTPK-amide | 2516 |
| GVIINVKCKISAQCL[Dpr]PCKDAGMRFGACMNGKCACTPK-amide | 2517 |
| GVIINVKCKISAQCL[Dab]PCKDAGMRFGACMNGKCACTPK-amide | 2518 |
| GVIINVKCKISAQCLOPCKDAGMRFGACMNGKCHC-amide | 2519 |
| GVIINVKCKISAQCL[hLys]PCKDAGMRFGACMNGKCHC-amide | 2520 |
| GVIINVKCKISAQCL[hArg]PCKDAGMRFGACMNGKCHC-amide | 2521 |
| GVIINVKCKISAQCL[Cit]PCKDAGMRFGACMNGKCHC-amide | 2522 |
| GVIINVKCKISAQCL[hCit]PCKDAGMRFGACMNGKCHC-amide | 2523 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCL[Dpr]PCKDAGMRFGACMNGKCHC-amide | 2524 |
| GVIINVKCKISAQCLOPCKDAGMRFGACMNGKCAC-amide | 2525 |
| GVIINVKCKISAQCL[hLys]PCKDAGMRFGACMNGKCAC-amide | 2526 |
| GVIINVKCKISAQCL[hArg]PCKDAGMRFGACMNGKCAC-amide | 2527 |
| GVIINVKCKISAQCL[Cit]PCKDAGMRFGACMNGKCAC-amide | 2528 |
| GVIINVKCKISAQCL[hCit]PCKDAGMRFGACMNGKCHC-amide | 2529 |
| GVIINVKCKISAQCL[Dpr]PCKDAGMRFGACMNGKCAC-amide | 2530 |
| GVIINVKCKISAQCL[Dab]PCKDAGMRFGACMNGKCAC-amide | 2531 |
| GVIINVKCKISAQCLKPCKDAGMRFGACMNGKCHCYGG-amide | 2532 |
| GVIINVKCKISAQCLOPCKDAGMRFGACMNGKCHCYGG-amide | 2533 |
| GVIINVKCKISAQCL[hLys]PCKDAGMRFGACMNGKCHCYGG-amide | 2534 |
| GVIINVKCKISAQCL[hArg]PCKDAGMRFGACMNGKCHCYGG-amide | 2535 |
| GVIINVKCKISAQCL[Cit]PCKDAGMRFGACMNGKCHCYGG-amide | 2536 |
| GVIINVKCKISAQCL[hCit]PCKDAGMRFGACMNGKCHCYGG-amide | 2537 |
| GVIINVKCKISAQCL[Dpr]PCKDAGMRFGACMNGKCHCYGG-amide | 2538 |
| GVIINVKCKISAQCLKPCKDAGMRFGACMNGKCHCFGG-amide | 2539 |
| GVIINVKCKISAQCLKPCKDAGMRFGACMNGKCHCYG-amide | 2540 |
| GVIINVKCKISAQCLKPCKDAGMRFGACMNGKCACYG-amide | 2541 |
| GVIINVKCKISAQCLOPCKDAGMRFGACMNGKCACYGG-amide | 2542 |
| GVIINVKCKISAQCL[hLys]PCKDAGMRFGACMNGKCACYGG-amide | 2543 |
| GVIINVKCKISAQCL[hArg]PCKDAGMRFGACMNGKCACYGG-amide | 2544 |
| GVIINVKCKISAQCL[Cit]PCKDAGMRFGACMNGKCACYGG-amide | 2545 |
| GVIINVKCKISAQCL[hCit]PCKDAGMRFGACMNGKCACYGG-amide | 2546 |
| GVIINVKCKISAQCL[Dpr]PCKDAGMRFGACMNGKCACYGG-amide | 2547 |
| GVIINVKCKISAQCL[Dab]PCKDAGMRFGACMNGKCACYGG-amide | 2548 |
| GVIINVKCKISAQCLKPCKDAGMRFGACMNGKCACYGG-amide | 2549 |
| GVIINVKCKISAQCLOPCKDAGMRFGACMNGKCHCGGG-amide | 2550 |
| GVIINVKCKISAQCL[hLys]PCKDAGMRFGACMNGKCHCGGG-amide | 2551 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCL[hArg]PCKDAGMRFGACMNGKCHCGGG-amide | 2552 |
| GVIINVKCKISAQCL[Cit]PCKDAGMRFGACMNGKCHCGGG-amide | 2553 |
| GVIINVKCKISAQCL[hCit]PCKDAGMRFGACMNGKCHCGGG-amide | 2554 |
| GVIINVKCKISAQCL[Dpr]PCKDAGMRFGACMNGKCHCGGG-amide | 2555 |
| GVIINVKCKISAQCLKPCKDAGMRFGACMNGKCACGGG-amide | 2556 |
| GVIINVKCKISAQCLOPCKDAGMRFGACMNGKCACFGG-amide | 2557 |
| GVIINVKCKISAQCLOPCKDAGMRFGACMNGKCACGGG-amide | 2558 |
| GVIINVKCKISAQCL[hLys]PCKDAGMRFGACMNGKCACGGG-amide | 2559 |
| GVIINVKCKISAQCL[hArg]PCKDAGMRFGACMNGKCACGGG-amide | 2560 |
| GVIINVKCKISAQCL[Cit]PCKDAGMRFGACMNGKCACGGG-amide | 2561 |
| GVIINVKCKISAQCL[hCit]PCKDAGMRFGACMNGKCACGGG-amide | 2562 |
| GVIINVKCKISAQCL[Dpr]PCKDAGMRFGACMNGKCACGGG-amide | 2563 |
| GVIINVKCKISAQCL[Dab]PCKDAGMRFGACMNGKCACGGG-amide | 2564 |
| GVIINVKCKISAQCLOPCKEAGMRFGACMNGKCHCTPK-amide | 2565 |
| GVIINVKCKISAQCL[hLys]PCKEAGMRFGACMNGKCHCTPK-amide | 2566 |
| GVIINVKCKISAQCL[hArg]PCKEAGMRFGACMNGKCHCTPK-amide | 2567 |
| GVIINVKCKISAQCL[Cit]PCKEAGMRFGACMNGKCHCTPK-amide | 2568 |
| GVIINVKCKISAQCL[hCit]PCKEAGMRFGACMNGKCHCTPK-amide | 2569 |
| GVIINVKCKISAQCL[Dpr]PCKEAGMRFGACMNGKCHCTPK-amide | 2570 |
| GVIINVKCKISAQCL[Dab]PCKEAGMRFGACMNGKCHCTPK-amide | 2571 |
| GVIINVKCKISAQCLOPCKEAGMRFGACMNGKCHCYPK-amide | 2572 |
| GVIINVKCKISAQCL[hLys]PCKEAGMRFGACMNGKCHCYPK-amide | 2573 |
| GVIINVKCKISAQCL[hArg]PCKEAGMRFGACMNGKCHCYPK-amide | 2574 |
| GVIINVKCKISAQCL[Cit]PCKEAGMRFGACMNGKCHCYPK-amide | 2575 |
| GVIINVKCKISAQCL[hCit]PCKEAGMRFGACMNGKCHCYPK-amide | 2576 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCL[Dpr]PCKEAGMRFGACMNGKCHCYPK-amide | 2577 |
| GVIINVKCKISAQCL[Dab]PCKEAGMRFGACMNGKCHCYPK-amide | 2578 |
| GVIINVKCKISAQCLOPCKEAGMRFGACMNGKCACTPK-amide | 2579 |
| GVIINVKCKISAQCL[hLys]PCKEAGMRFGACMNGKCACTPK-amide | 2580 |
| GVIINVKCKISAQCL[hArg]PCKEAGMRFGACMNGKCACTPK-amide | 2581 |
| GVIINVKCKISAQCL[Cit]PCKEAGMRFGACMNGKCACTPK-amide | 2582 |
| GVIINVKCKISAQCL[hCit]PCKEAGMRFGACMNGKCACTPK-amide | 2583 |
| GVIINVKCKISAQCL[Dpr]PCKEAGMRFGACMNGKCACTPK-amide | 2584 |
| GVIINVKCKISAQCL[Dab]PCKEAGMRFGACMNGKCACTPK-amide | 2585 |
| GVIINVKCKISAQCLOPCKEAGMRFGACMNGKCHC-amide | 2586 |
| GVIINVKCKISAQCL[hLys]PCKEAGMRFGACMNGKCHC-amide | 2587 |
| GVIINVKCKISAQCL[hArg]PCKEAGMRFGACMNGKCHC-amide | 2588 |
| GVIINVKCKISAQCL[Cit]PCKEAGMRFGACMNGKCHC-amide | 2589 |
| GVIINVKCKISAQCL[hCit]PCKEAGMRFGACMNGKCHC-amide | 2590 |
| GVIINVKCKISAQCL[Dpr]PCKEAGMRFGACMNGKCHC-amide | 2591 |
| GVIINVKCKISAQCLOPCKEAGMRFGACMNGKCAC-amide | 2592 |
| GVIINVKCKISAQCL[hLys]PCKEAGMRFGACMNGKCAC-amide | 2593 |
| GVIINVKCKISAQCL[hArg]PCKEAGMRFGACMNGKCAC-amide | 2594 |
| GVIINVKCKISAQCL[Cit]PCKEAGMRFGACMNGKCAC-amide | 2595 |
| GVIINVKCKISAQCL[hCit]PCKEAGMRFGACMNGKCHC-amide | 2596 |
| GVIINVKCKISAQCL[Dpr]PCKEAGMRFGACMNGKCAC-amide | 2597 |
| GVIINVKCKISAQCL[Dab]PCKEAGMRFGACMNGKCAC-amide | 2598 |
| GVIINVKCKISAQCLKPCKEAGMRFGACMNGKCHCWGG-amide | 2599 |
| GVIINVKCKISAQCLOPCKEAGMRFGACMNGKCHCYGG-amide | 2600 |
| GVIINVKCKISAQCL[hLys]PCKEAGMRFGACMNGKCHCYGG-amide | 2601 |
| GVIINVKCKISAQCL[hArg]PCKEAGMRFGACMNGKCHCYGG-amide | 2602 |
| GVIINVKCKISAQCL[Cit]PCKEAGMRFGACMNGKCHCYGG-amide | 2603 |
| GVIINVKCKISAQCL[hCit]PCKEAGMRFGACMNGKCHCYGG-amide | 2604 |
| GVIINVKCKISAQCL[Dpr]PCKEAGMRFGACMNGKCHCYGG-amide | 2605 |
| GVIINVKCKISAQCL[Dab]PCKEAGMRFGACMNGKCHCYGG-amide | 2606 |
| GVIINVKCKISAQCLKPCKEAGMRFGACMNGKCACYGG-amide | 2607 |
| GVIINVKCKISAQCLOPCKEAGMRFGACMNGKCACYGG-amide | 2608 |
| GVIINVKCKISAQCL[hLys]PCKEAGMRFGACMNGKCACYGG-amide | 2609 |
| GVIINVKCKISAQCL[hArg]PCKEAGMRFGACMNGKCACYGG-amide | 2610 |
| GVIINVKCKISAQCL[Cit]PCKEAGMRFGACMNGKCACYGG-amide | 2611 |
| GVIINVKCKISAQCL[hCit]PCKEAGMRFGACMNGKCHCYGG-amide | 2612 |
| GVIINVKCKISAQCL[Dpr]PCKEAGMRFGACMNGKCACYGG-amide | 2613 |
| GVIINVKCKISAQCL[Dab]PCKEAGMRFGACMNGKCACYGG-amide | 2614 |
| GVIINVKCKISAQCLOPCKEAGMRFGACMNGKCHCGGG-amide | 2615 |
| GVIINVKCKISAQCL[hLys]PCKEAGMRFGACMNGKCHCGGG-amide | 2616 |
| GVIINVKCKISAQCL[hArg]PCKEAGMRFGACMNGKCHCGGG-amide | 2617 |
| GVIINVKCKISAQCL[Cit]PCKEAGMRFGACMNGKCHCGGG-amide | 2618 |
| GVIINVKCKISAQCL[hCit]PCKEAGMRFGACMNGKCHCGGG-amide | 2619 |
| GVIINVKCKISAQCL[Dpr]PCKEAGMRFGACMNGKCHCGGG-amide | 2620 |
| GVIINVKCKISAQCLOPCKEAGMRFGACMNGKCACGGG-amide | 2621 |
| GVIINVKCKISAQCL[hLys]PCKEAGMRFGACMNGKCACGGG-amide | 2622 |
| GVIINVKCKISAQCL[hArg]PCKEAGMRFGACMNGKCACGGG-amide | 2623 |
| GVIINVKCKISAQCL[Cit]PCKEAGMRFGACMNGKCACGGG-amide | 2624 |
| GVIINVKCKISAQCL[hCit]PCKEAGMRFGACMNGKCACTP-amide | 2625 |
| GVIINVKCKISAQCL[Dpr]PCKEAGMRFGACMNGKCACGGG-amide | 2626 |
| GVIINVKCKISAQCL[Dab]PCKEAGMRFGACMNGKCACGGG-amide | 2627 |
| GVIINVKCKISAQCLKPCK[Cpa]AGMRFGACMNGKCACYGG-amide | 2628 |

TABLE 7C-continued

Additional useful OSK1 peptide analog sequences: Ala-12 & Ala27 Substituted Series

| Sequence/structure | SEQ ID NO: |
|---|---|
| GVIINVKCKISAQCLKPCK[Cpa]AGMRFGACMNGKCACGGG-amide | 2629 |
| GVIINVKCKISAQCLKPCK[Cpa]AGMRFGACMNGKCACY-amide | 2630 |
| Ac-GVIINVKCKISAQCLKPCKDAGMRFGACMNGKCACYGG-amide | 2631 |
| GVIINVKCKISAQCLKPCK[Aad]AGMRFGACMNGKCACYGG-amide | 2632 |
| GVIINVKCKISAQCLKPCK[Aad]AGMRFGACMNGKCHCYGG-amide | 2633 |
| GVIINVKCKISAQCLKPCK[Aad]AGMRFGACMNGKCACYGG | 2634 |
| GVIINVKCKISAQCLHPCKDAGMRFGACMNGKCACYGG-amide | 2635 |
| GVIINVKCKISAQCLHPCKDAGMRFGACMNGKCACYGG | 2636 |
| GVIINVKCKISAQCLHPCKDAGMRFGACMNGKCACY-amide | 2637 |
| GVIINVKCKISAQCLHPCKDAGMRFGACMNGKCHCYGG-amide | 2638 |
| GVIINVKCKISAQCLHPCKDAGMRFGACMNGKCHCYGG | 2639 |
| GVIINVKCKISAQCLHPCKDAGMRFGACMNGKCHCYPK | 2640 |
| GVIINVKCKISAQCLHPCKDAGMRFGACMNGKCAC | 2641 |
| GVIINVKCKISAQCLKPCKDAGMRFGACMNGKCAC[1Nal]GG-amide | 2642 |
| GVIINVKCKISAQCLKPCKDAGMRFGACMNGKCAC[1Nal]PK-amide | 2643 |
| GVIINVKCKISAQCLKPCKDAGMRFGACMNGKCAC[2Nal]GG-amide | 2644 |
| GVIINVKCKISAQCLKPCKDAGMRFGACMNGKCAC[Cha]GG-amide | 2645 |
| GVIINVKCKISAQCLKPCKDAGMRFGACMNGKCAC[MePhe]GG-amide | 2646 |
| GVIINVKCKISAQCLKPCKDAGMRFGACMNGKCAC[BiPhA]GG-amide | 2647 |
| GVIINVKCKISAQCLKPCKDAGMRFGACMNGKC[Aib]CYGG-amide | 2648 |
| GVIINVKCKISAQCLKPCKDAGMRFGACMNGKC[Abu]CYGG-amide | 2649 |
| GVIINVKCKISAQCLKPCKDAGMRFGACMNGKCAC[1Nal] | 2650 |
| GVIINVKCKISAQCLHPCKDAGMRFGACMNGKCAC[1Nal]GG-amide | 2651 |
| GVIINVKCKISAQCLKPCKDAGMRFGACMNGKCAC[4Bip]-amide | 2652 |
| GVIINVKCKISAQCLHPCKDAGMRFGACMNGKCAC[4Bip]GG-amide | 2653 |
| GVIINVKCKISAQCLKPCKDAGMRFGACMNGKCHCGGG | 2654 |

TABLE 7D

Additional useful OSK1 peptide analog sequences: Ala-12 & Ala29 Substituted Series

| Sequence/structure | SEQ ID NO: |
|---|---|
| GVIINVKCKISAQCLEPCKKAGMRFGKCANGKCHCTPK | 2655 |
| GVIINVSCKISAQCLEPCKKAGMRFGKCANGKCHCTPK | 2656 |
| GVIINVKCKISAQCLKPCKKAGMRFGKCANGKCHCTPK | 2657 |
| GVIINVKCKISAQCLEPCKDAGMRFGKCANGKCHCTPK | 2658 |
| GVIINVKCKISAQCLKPCKDAGMRFGKCANGKCHCTPK | 2659 |
| GVIINVSCKISAQCLKPCKDAGMRFGKCANGKCHCTPK | 2660 |
| GVIINVKCKISPQCLKPCKDAGMRFGKCANGKCHCTPK | 2661 |
| GVIINVKCKISAQCLKPCKDAGMRFGKCANGKCHCYPK | 2662 |
| Ac-GVIINVKCKISPQCLKPCKDAGMRFGKCANGKCHCTPK | 2663 |
| GVIINVKCKISPQCLKPCKDAGMRFGKCANGKCHCTPK-amide | 2664 |
| Ac-GVIINVKCKISPQCLKPCKDAGMRFGKCANGKCHCTPK-amide | 2665 |
| GVIINVKCKISAQCLKPCKDAGMRFGKCANGKCHCYPK-amide | 2666 |
| Ac-GVIINVKCKISAQCLKPCKDAGMRFGKCANGKCHCYPK | 2667 |
| Ac-GVIINVKCKISAQCLKPCKDAGMRFGKCANGKCHCYPK-amide | 2668 |
| GVIINVKCKISAQCLKPCKKAGMRFGKCANGKCHCTPK-amide | 2669 |
| Ac-GVIINVKCKISAQCLKPCKKAGMRFGKCANGKCHCTPK | 2670 |
| Ac-GVIINVKCKISAQCLKPCKKAGMRFGKCANGKCHCTPK-amide | 2671 |
| Ac-GVIINVKCKISAQCLEPCKDAGMRFGKCANGKCHCTPK | 2672 |
| GVIINVKCKISAQCLEPCKDAGMRFGKCANGKCHCTPK-amide | 2673 |
| Ac-GVIINVKCKISAQCLEPCKDAGMRFGKCANGKCHCTPK-amide | 2674 |
| GVIINVKCKISAQCLEPCKKAGMRFGKCANGKCHCTPK-amide | 2675 |
| Ac-GVIINVKCKISAQCLEPCKKAGMRFGKCANGKCHCTPK | 2676 |
| Ac-GVIINVKCKISAQCLEPCKKAGMRFGKCANGKCHCTPK-amide | 2677 |
| GVIINVKCKISAQCLKPCKDAGMRFGKCANGKCHCTPK-amide | 2678 |
| Ac-GVIINVKCKISAQCLKPCKDAGMRFGKCANGKCHCTPK | 2679 |
| Ac-GVIINVKCKISAQCLKPCKDAGMRFGKCANGKCHCTPK-amide | 2680 |
| VIINVKCKISAQCLEPCKKAGMRFGKCANGKCHCTPK | 2681 |
| Ac-VTINVKCKISAQCLEPCKKAGMRFGKCANGKCHCTPK | 2682 |
| VIINVKCKISAQCLEPCKKAGMRFGKCANGKCHCTPK-amide | 2683 |
| Ac-VIINVKCKISAQCLEPCKKAGMRFGKCANGKCHCTPK-amide | 2684 |
| GVIINVKCKISAQCLEPCKKAGMRFGKCANGKCACTPK | 2685 |
| Ac-GVIINVKCKISAQCLEPCKKAGMRFGKCANGKCACTPK | 2686 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCLEPCKKAGMRFGKCANGKCACTPK-amide | 2687 |
| Ac-GVIINVKCKISAQCLEPCKKAGMRFGKCANGKCACTPK-amide | 2688 |
| VIINVKCKISAQCLKPCKDAGMRFGKCANGKCHCTPK | 2689 |
| Ac-VIINVKCKISAQCLKPCKDAGMRFGKCANGKCHCTPK | 2690 |
| VIINVKCKISAQCLKPCKDAGMRFGKCANGKCHCTPK-amide | 2691 |
| Ac-VIINVKCKISAQCLKPCKDAGMRFGKCANGKCHCTPK-amide | 2692 |
| NVKCKISAQCLKPCKDAGMRFGKCANGKCHCTPK | 2693 |
| Ac-NVKCKISAQCLKPCKDAGMRFGKCANGKCHCTPK | 2694 |
| NVKCKISAQCLKPCKDAGMRFGKCANGKCHCTPK-amide | 2695 |
| Ac-NVKCKISAQCLKPCKDAGMRFGKCANGKCHCTPK-amide | 2696 |
| KCKISAQCLKPCKDAGMRFGKCANGKCHCTPK | 2697 |
| Ac-KCKISAQCLKPCKDAGMRFGKCANGKCHCTPK | 2698 |
| KCKISAQCLKPCKDAGMRFGKCANGKCHCTPK-amide | 2699 |
| Ac-KCKISAQCLKPCKDAGMRFGKCANGKCHCTPK-amide | 2700 |
| CKISAQCLKPCKDAGMRFGKCANGKCHCTPK | 2701 |
| Ac-CKISAQCLKPCKDAGMRFGKCANGKCHCTPK | 2702 |
| CKISAQCLKPCKDAGMRFGKCANGKCHCTPK-amide | 2703 |
| Ac-CKISAQCLKPCKDAGMRFGKCANGKCHCTPK-amide | 2704 |
| GVIINVKCKISAQCLKPCKDAGMRNGKCANGKCHCTPK | 2705 |
| GVIINVKCKISAQCLKPCKDAGMRNGKCANGKCHCTPK-amide | 2706 |
| Ac-GVIINVKCKISAQCLKPCKDAGMRNGKCANGKCHCTPK | 2707 |
| Ac-GVIINVKCKISAQCLKPCKDAGMRNGKCANGKCHCTPK-amide | 2708 |
| GVIINVKCKISAQCLKPCKDAGMRFGKCMNRKCHCTPK | 2709 |
| GVIINVKCKISAQCLKPCKDAGMRFGKCMNRKCHCTPK-amide | 2710 |
| Ac-GVIINVKCKISAQCLKPCKDAGMRFGKCMNRKCHCTPK | 2711 |
| Ac-GVIINVKCKISAQCLKPCKDAGMRFGKCMNRKCHCTPK-amide | 2712 |
| GVIINVKCKISKQCLKPCRDAGMRFGKCANGKCHCTPK | 2713 |
| Ac-GVIINVKCKISKQCLKPCRDAGMRFGKCANGKCHCTPK | 2714 |
| GVIINVKCKISKQCLKPCRDAGMRFGKCANGKCHCTPK-amide | 2715 |
| Ac-GVIINVKCKISKQCLKPCRDAGMRFGKCANGKCHCTPK-amide | 2716 |
| TIINVKCKISAQCLKPCKDAGMRFGKCANGKCHCTPK | 2717 |
| Ac-TIINVKCKISAQCLKPCKDAGMRFGKCANGKCHCTPK | 2718 |
| TIINVKCKISAQCLKPCKDAGMRFGKCANGKCHCTPK-amide | 2719 |

TABLE 7D-continued

Additional useful OSK1 peptide analog sequences: Ala-12 & Ala29 Substituted Series

| Sequence/structure | SEQ ID NO: |
|---|---|
| Ac-TIINVKCKISAQCLKPCKDAGMRFGKCANGKCHCTPK-amide | 2720 |
| GVKINVKCKISAQCLEPCKKAGMRFGKCANGKCHCTPK | 2721 |
| Ac-GVKINVKCKISAQCLEPCKKAGMRFGKCANGKCHCTPK | 2722 |
| GVKINVKCKISAQCLEPCKKAGMRFGKCANGKCHCTPK-amide | 2723 |
| Ac-GVKINVKCKISAQCLEPCKKAGMRFGKCANGKCHCTPK-amide | 2724 |
| GVKINVKCKISAQCLEPCKKAGMRFGKCANGKCACTPK | 2725 |
| GVKINVKCKISAQCLKPCKDAGMRFGKCANGKCHCTPK | 2726 |
| GVKINVKCKISAQCLKPCKDAGMRFGKCANGKCACTPK | 2727 |
| Ac-GVKINVKCKISAQCLEPCKKAGMRFGKCANGKCACTPK | 2728 |
| GVKINVKCKISAQCLEPCKKAGMRFGKCANGKCACTPK-amide | 2729 |
| Ac-GVKINVKCKISAQCLEPCKKAGMRFGKCANGKCACTPK-amide | 2730 |
| Ac-GVKINVKCKISAQCLKPCKDAGMRFGKCANGKCACTPK | 2731 |
| GVKINVKCKISAQCLKPCKDAGMRFGKCANGKCACTPK-amide | 2732 |
| Ac-GVKINVKCKISAQCLKPCKDAGMRFGKCANGKCACTPK-amide | 2733 |
| Ac-GVKINVKCKISAQCLKPCKDAGMRFGKCANGKCHCTPK | 2734 |
| GVKINVKCKISAQCLKPCKDAGMRFGKCANGKCHCTPK-amide | 2735 |
| Ac-GVKINVKCKISAQCLKPCKDAGMRFGKCANGKCHCTPK-amide | 2736 |
| GVIINVKCKISAQCLKPCKDAGMRFGKCANGKCHCT | 2737 |
| GVIINVKCKISAQCLOPCKDAGMRFGKCANGKCHCTPK | 2738 |
| GVIINVKCKISAQCL[hLys]PCKDAGMRFGKCANGKCHCTPK | 2739 |
| GVIINVKCKISAQCL[hArg]PCKDAGMRFGKCANGKCHCTPK | 2740 |
| GVIINVKCKISAQCL[Cit]PCKDAGMRFGKCANGKCHCTPK | 2741 |
| GVIINVKCKISAQCL[hCit]PCKDAGMRFGKCANGKCHCTPK | 2742 |
| GVIINVKCKISAQCL[Dpr]PCKDAGMRFGKCANGKCHCTPK | 2743 |
| GVIINVKCKISAQCL[Dab]PCKDAGMRFGKCANGKCHCTPK | 2744 |
| GVIINVKCKISAQCLOPCKDAGMRFGKCANGKCHCYPK | 2745 |
| GVIINVKCKISAQCL[hLys]PCKDAGMRFGKCANGKCHCYPK | 2746 |
| GVIINVKCKISAQCL[hArg]PCKDAGMRFGKCANGKCHCYPK | 2747 |
| GVIINVKCKISAQCL[Cit]PCKDAGMRFGKCANGKCHCYPK | 2748 |
| GVIINVKCKISAQCL[hCit]PCKDAGMRFGKCANGKCHCYPK | 2749 |
| GVIINVKCKISAQCL[Dpr]PCKDAGMRFGKCANGKCHCYPK | 2750 |
| GVIINVKCKISAQCL[Dab]PCKDAGMRFGKCANGKCHCYPK | 2751 |
| GVIINVKCKISAQCLKPCKDAGMRFGKCANGKCACYPK | 2752 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCLKPCKDAGMRFGKCANGKCGCYPK | 2753 |
| GVIINVKCKISAQCLKPCKDAGMRFGKCANGKCACFPK | 2754 |
| GVIINVKCKISAQCLKPCKDAGMRFGKCANGKCACWPK | 2755 |
| GVIINVKCKISAQCLKPCKEAGMRFGKCANGKCACYPK | 2756 |
| GVIINVKCKISAQCLOPCKDAGMRFGKCANGKCACTPK | 2757 |
| GVIINVKCKISAQCL[hLys]PCKDAGMRFGKCANGKCACTPK | 2758 |
| GVIINVKCKISAQCL[hArg]PCKDAGMRFGKCANGKCACTPK | 2759 |
| GVIINVKCKISAQCL[Cit]PCKDAGMRFGKCANGKCACTPK | 2760 |
| GVIINVKCKISAQCL[hCit]PCKDAGMRFGKCANGKCHCTPK | 2761 |
| GVIINVKCKISAQCL[Dpr]PCKDAGMRFGKCANGKCACTPK | 2762 |
| GVIINVKCKISAQCL[Dab]PCKDAGMRFGKCANGKCACTPK | 2763 |
| GVIINVKCKISAQCLOPCKDAGMRFGKCANGKCHC | 2764 |
| GVIINVKCKISAQCL[hLys]PCKDAGMRFGKCANGKCHC | 2765 |
| GVIINVKCKISAQCL[hArg]PCKDAGMRFGKCANGKCHC | 2766 |
| GVIINVKCKISAQCL[Cit]PCKDAGMRFGKCANGKCHC | 2767 |
| GVIINVKCKISAQCL[hCit]PCKDAGMRFGKCANGKCHC | 2768 |
| GVIINVKCKISAQCL[Dpr]PCKDAGMRFGKCANGKCHC | 2769 |
| GVIINVKCKISAQCL[Dab]PCKDAGMRFGKCANGKCHC | 2770 |
| GVIINVKCKISAQCLOPCKDAGMRFGKCANGKCAC | 2771 |
| GVIINVKCKISAQCL[hLys]PCKDAGMRFGKCANGKCAC | 2772 |
| GVIINVKCKISAQCL[hArg]PCKDAGMRFGKCANGKCAC | 2773 |
| GVIINVKCKISAQCL[Cit]PCKDAGMRFGKCANGKCAC | 2774 |
| GVIINVKCKISAQCL[hCit]PCKDAGMRFGKCANGKCHC | 2775 |
| GVIINVKCKISAQCL[Dpr]PCKDAGMRFGKCANGKCAC | 2776 |
| GVIINVKCKISAQCL[Dab]PCKDAGMRFGKCANGKCAC | 2777 |
| GVIINVKCKISAQCLKPCKDAGMRFGKCANGKCGCYGG | 2778 |
| GVIINVKCKISAQCLOPCKDAGMRFGKCANGKCHCYGG | 2779 |
| GVIINVKCKISAQCL[hLys]PCKDAGMRFGKCANGKCHCYGG | 2780 |
| GVIINVKCKISAQCL[hArg]PCKDAGMRFGKCANGKCHCYGG | 2781 |
| GVIINVKCKISAQCL[Cit]PCKDAGMRFGKCANGKCHCYGG | 2782 |
| GVIINVKCKISAQCL[hCit]PCKDAGMRFGKCANGKCHCYGG | 2783 |
| GVIINVKCKISAQCL[Dpr]PCKDAGMRFGKCANGKCHCYGG | 2784 |
| GVIINVKCKISAQCLKPCKDAGMRFGKCANGKCACYGG | 2785 |
| GVIINVKCKISAQCLOPCKDAGMRFGKCANGKCACYGG | 2786 |
| GVIINVKCKISAQCL[hLys]PCKDAGMRFGKCANGKCACYGG | 2787 |
| GVIINVKCKISAQCL[hArg]PCKDAGMRFGKCANGKCACYGG | 2788 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCL[Cit]PCKDAGMRFGKCANGKCACYGG | 2789 |
| GVIINVKCKISAQCL[hCit]PCKDAGMRFGKCANGKCHCYGG | 2790 |
| GVIINVKCKISAQCL[Dpr]PCKDAGMRFGKCANGKCACYGG | 2791 |
| GVIINVKCKISAQCL[Dab]PCKDAGMRFGKCANGKCACYGG | 2792 |
| GVIINVKCKISAQCLKPCKDAGMRFGKCANGKCACYG | 2793 |
| GVIINVKCKISAQCLOPCKDAGMRFGKCANGKCHCGGG | 2794 |
| GVIINVKCKISAQCL[hLys]PCKDAGMRFGKCANGKCHCGGG | 2795 |
| GVIINVKCKISAQCL[hArg]PCKDAGMRFGKCANGKCHCGGG | 2796 |
| GVIINVKCKISAQCL[Cit]PCKDAGMRFGKCANGKCHCGGG | 2797 |
| GVIINVKCKISAQCL[hCit]PCKDAGMRFGKCANGKCHCGGG | 2798 |
| GVIINVKCKISAQCL[Dpr]PCKDAGMRFGKCANGKCHCGGG | 2799 |
| GVIINVKCKISAQCLKPCKDAGMRFGKCANGKCACFGG | 2800 |
| GVIINVKCKISAQCLOPCKDAGMRFGKCANGKCACGGG | 2801 |
| GVIINVKCKISAQCL[hLys]PCKDAGMRFGKCANGKCACGGG | 2802 |
| GVIINVKCKISAQCL[hArg]PCKDAGMRFGKCANGKCACGGG | 2803 |
| GVIINVKCKISAQCL[Cit]PCKDAGMRFGKCANGKCACGGG | 2804 |
| GVIINVKCKISAQCL[hCit]PCKDAGMRFGKCANGKCACGGG | 2805 |
| GVIINVKCKISAQCL[Dpr]PCKDAGMRFGKCANGKCACGGG | 2806 |
| GVIINVKCKISAQCL[Dab]PCKDAGMRFGKCANGKCACGGG | 2807 |
| GVIINVKCKISAQCLKPCKDAGMRFGKCANGKCACGG | 2808 |
| GVIINVKCKISAQCLKPCKDAGMRFGKCANGKCACYG | 2809 |
| GVIINVKCKISAQCLOPCKDAGMRFGKCANGKCACGG | 2810 |
| GVIINVKCKISAQCL[hLys]PCKEAGMRFGKCANGKCHCTPK | 2811 |
| GVIINVKCKISAQCL[hArg]PCKEAGMRFGKCANGKCHCTPK | 2812 |
| GVIINVKCKISAQCL[Cit]PCKEAGMRFGKCANGKCHCTPK | 2813 |
| GVIINVKCKISAQCL[hCit]PCKEAGMRFGKCANGKCHCTPK | 2814 |
| GVIINVKCKISAQCL[Dpr]PCKEAGMRFGKCANGKCHCTPK | 2815 |
| GVIINVKCKISAQCL[Dab]PCKEAGMRFGKCANGKCHCTPK | 2816 |
| GVIINVKCKISAQCLOPCKEAGMRFGKCANGKCHCYPK | 2817 |
| GVIINVKCKISAQCL[hLys]PCKEAGMRFGKCANGKCHCYPK | 2818 |
| GVIINVKCKISAQCL[hArg]PCKEAGMRFGKCANGKCHCYPK | 2819 |
| GVIINVKCKISAQCL[Cit]PCKEAGMRFGKCANGKCHCYPK | 2820 |
| GVIINVKCKISAQCL[hCit]PCKEAGMRFGKCANGKCHCYPK | 2821 |
| GVIINVKCKISAQCL[Dpr]PCKEAGMRFGKCANGKCHCYPK | 2822 |
| GVIINVKCKISAQCL[Dab]PCKEAGMRFGKCANGKCHCYPK | 2823 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCLOPCKEAGMRFGKCANGKCACTPK | 2824 |
| GVIINVKCKISAQCL[hLys]PCKEAGMRFGKCANGKCACTPK | 2825 |
| GVIINVKCKISAQCL[hArg]PCKEAGMRFGKCANGKCACTPK | 2826 |
| GVIINVKCKISAQCL[Cit]PCKEAGMRFGKCANGKCACTPK | 2827 |
| GVIINVKCKISAQCL[hCit]PCKEAGMRFGKCANGKCHCTPK | 2828 |
| GVIINVKCKISAQCL[Dpr]PCKEAGMRFGKCANGKCACTPK | 2829 |
| GVIINVKCKISAQCL[Dab]PCKEAGMRFGKCANGKCACTPK | 2830 |
| GVIINVKCKISAQCLOPCKEAGMRFGKCANGKCHC | 2831 |
| GVIINVKCKISAQCL[hLys]PCKEAGMRFGKCANGKCHC | 2832 |
| GVIINVKCKISAQCL[hArg]PCKEAGMRFGKCANGKCHC | 2833 |
| GVIINVKCKISAQCL[Cit]PCKEAGMRFGKCANGKCHC | 2834 |
| GVIINVKCKISAQCL[hCit]PCKEAGMRFGKCANGKCHC | 2835 |
| GVIINVKCKISAQCL[Dpr]PCKEAGMRFGKCANGKCHC | 2836 |
| GVIINVKCKISAQCLOPCKEAGMRFGKCANGKCAC | 2837 |
| GVIINVKCKISAQCL[hLys]PCKEAGMRFGKCANGKCAC | 2838 |
| GVIINVKCKISAQCL[hArg]PCKEAGMRFGKCANGKCAC | 2839 |
| GVIINVKCKISAQCL[Cit]PCKEAGMRFGKCANGKCAC | 2840 |
| GVIINVKCKISAQCL[hCit]PCKEAGMRFGKCANGKCHC | 2841 |
| GVIINVKCKISAQCL[Dpr]PCKEAGMRFGKCANGKCAC | 2842 |
| GVIINVKCKISAQCL[Dab]PCKEAGMRFGKCANGKCAC | 2843 |
| GVIINVKCKISAQCLKPCKEAGMRFGKCANGKCHCYGG | 2844 |
| GVIINVKCKISAQCLOPCKEAGMRFGKCANGKCHCYGG | 2845 |
| GVIINVKCKISAQCLKPCKEAGMRFGKCANGKCHCYG | 2846 |
| GVIINVKCKISAQCLKPCKEAGMRFGKCANGKCACYG | 2847 |
| GVIINVKCKISAQCL[hLys]PCKEAGMRFGKCANGKCHCYGG | 2848 |
| GVIINVKCKISAQCL[hArg]PCKEAGMRFGKCANGKCHCYGG | 2849 |
| GVIINVKCKISAQCL[Cit]PCKEAGMRFGKCANGKCHCYGG | 2850 |
| GVIINVKCKISAQCL[hCit]PCKEAGMRFGKCANGKCHCYGG | 2851 |
| GVIINVKCKISAQCL[Dpr]PCKEAGMRFGKCANGKCHCYGG | 2852 |
| GVIINVKCKISAQCL[Dab]PCKEAGMRFGKCANGKCHCYGG | 2853 |
| GVIINVKCKISAQCLKPCKEAGMRFGKCANGKCACYG | 2854 |
| GVIINVKCKISAQCLOPCKEAGMRFGKCANGKCACYGG | 2855 |
| GVIINVKCKISAQCL[hLys]PCKEAGMRFGKCANGKCACYGG | 2856 |
| GVIINVKCKISAQCL[hArg]PCKEAGMRFGKCANGKCACYGG | 2857 |
| GVIINVKCKISAQCL[Cit]PCKEAGMRFGKCANGKCACYGG | 2858 |
| GVIINVKCKISAQCL[hCit]PCKEAGMRFGKCANGKCHCYGG | 2859 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCL[Dpr]PCKEAGMRFGKCANGKCACYGG | 2860 |
| GVIINVKCKISAQCL[Dab]PCKEAGMRFGKCANGKCACYGG | 2861 |
| GVIINVKCKISAQCLKPCKEAGMRFGKCANGKCACFGG | 2862 |
| GVIINVKCKISAQCLOPCKEAGMRFGKCANGKCHCGGG | 2863 |
| GVIINVKCKISAQCL[hLys]PCKEAGMRFGKCANGKCHCGGG | 2864 |
| GVIINVKCKISAQCL[hArg]PCKEAGMRFGKCANGKCHCGGG | 2865 |
| GVIINVKCKISAQCL[Cit]PCKEAGMRFGKCANGKCHCGGG | 2866 |
| GVIINVKCKISAQCL[hCit]PCKEAGMRFGKCANGKCHCGGG | 2867 |
| GVIINVKCKISAQCL[Dpr]PCKEAGMRFGKCANGKCHCGGG | 2868 |
| GVIINVKCKISAQCLOPCKEAGMRFGKCANGKCACGGG | 2869 |
| GVIINVKCKISAQCL[hLys]PCKEAGMRFGKCANGKCACGGG | 2870 |
| GVIINVKCKISAQCL[hArg]PCKEAGMRFGKCANGKCACGGG | 2871 |
| GVIINVKCKISAQCL[Cit]PCKEAGMRFGKCANGKCACGGG | 2872 |
| GVIINVKCKISAQCL[hCit]PCKEAGMRFGKCANGKCACTP | 2873 |
| GVIINVKCKISAQCL[Dpr]PCKEAGMRFGKCANGKCACTP | 2874 |
| GVIINVKCKISAQCL[Dab]PCKEAGMRFGKCANGKCACTP | 2875 |
| GVIINVKCKISAQCLOPCKDAGMRFGKCANGKCHCTPK-amide | 2876 |
| GVIINVKCKISAQCL[hLys]PCKDAGMRFGKCANGKCHCTPK-amide | 2877 |
| GVIINVKCKISAQCL[hArg]PCKDAGMRFGKCANGKCHCTPK-amide | 2878 |
| GVIINVKCKISAQCL[Cit]PCKDAGMRFGKCANGKCHCTPK-amide | 2879 |
| GVIINVKCKISAQCL[hCit]PCKDAGMRFGKCANGKCHCTPK-amide | 2880 |
| GVIINVKCKISAQCL[Dpr]PCKDAGMRFGKCANGKCHCTPK-amide | 2881 |
| GVIINVKCKISAQCL[Dab]PCKDAGMRFGKCANGKCHCTPK-amide | 2882 |
| GVIINVKCKISAQCLOPCKDAGMRFGKCANGKCHCYPK-amide | 2883 |
| GVIINVKCKISAQCL[hLys]PCKDAGMRFGKCANGKCHCYPK-amide | 2884 |
| GVIINVKCKISAQCL[hArg]PCKDAGMRFGKCANGKCHCYPK-amide | 2885 |
| GVIINVKCKISAQCL[Cit]PCKDAGMRFGKCANGKCHCYPK-amide | 2886 |
| GVIINVKCKISAQCL[hCit]PCKDAGMRFGKCANGKCHCYPK-amide | 2887 |
| GVIINVKCKISAQCL[Dpr]PCKDAGMRFGKCANGKCHCYPK-amide | 2888 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCL[Dab]PCKDAGMRFGKCANGKCHCYPK-amide | 2889 |
| GVIINVKCKISAQCLOPCKDAGMRFGKCANGKCACTPK-amide | 2890 |
| GVIINVKCKISAQCL[hLys]PCKDAGMRFGKCANGKCACTPK-amide | 2891 |
| GVIINVKCKISAQCL[hArg]PCKDAGMRFGKCANGKCACTPK-amide | 2892 |
| GVIINVKCKISAQCL[Cit]PCKDAGMRFGKCANGKCACTPK-amide | 2893 |
| GVIINVKCKISAQCL[hCit]PCKDAGMRFGKCANGKCACTPK-amide | 2894 |
| GVIINVKCKISAQCL[Dpr]PCKDAGMRFGKCANGKCACTPK-amide | 2895 |
| GVIINVKCKISAQCL[Dab]PCKDAGMRFGKCANGKCACTPK-amide | 2896 |
| GVIINVKCKISAQCLOPCKDAGMRFGKCANGKCHC-amide | 2897 |
| GVIINVKCKISAQCL[hLys]PCKDAGMRFGKCANGKCHC-amide | 2898 |
| GVIINVKCKISAQCL[hArg]PCKDAGMRFGKCANGKCHC-amide | 2899 |
| GVIINVKCKISAQCL[Cit]PCKDAGMRFGKCANGKCHC-amide | 2900 |
| GVIINVKCKISAQCL[hCit]PCKDAGMRFGKCANGKCHC-amide | 2901 |
| GVIINVKCKISAQCL[Dpr]PCKDAGMRFGKCANGKCHC-amide | 2902 |
| GVIINVKCKISAQCLOPCKDAGMRFGKCANGKCAC-amide | 2903 |
| GVIINVKCKISAQCL[hLys]PCKDAGMRFGKCANGKCAC-amide | 2904 |
| GVIINVKCKISAQCL[hArg]PCKDAGMRFGKCANGKCAC-amide | 2905 |
| GVIINVKCKISAQCL[Cit]PCKDAGMRFGKCANGKCAC-amide | 2906 |
| GVIINVKCKISAQCL[hCit]PCKDAGMRFGKCANGKCHC-amide | 2907 |
| GVIINVKCKISAQCL[Dpr]PCKDAGMRFGKCANGKCAC-amide | 2908 |
| GVIINVKCKISAQCL[Dab]PCKDAGMRFGKCANGKCAC-amide | 2909 |
| GVIINVKCKISAQCLKPCKDAGMRFGKCANGKCHCYGG-amide | 2910 |
| GVIINVKCKISAQCLOPCKDAGMRFGKCANGKCHCYGG-amide | 2911 |
| GVIINVKCKISAQCL[hLys]PCKDAGMRFGKCANGKCHCYGG-amide | 2912 |
| GVIINVKCKISAQCL[hArg]PCKDAGMRFGKCANGKCHCYGG-amide | 2913 |
| GVIINVKCKISAQCL[Cit]PCKDAGMRFGKCANGKCHCYGG-amide | 2914 |
| GVIINVKCKISAQCL[hCit]PCKDAGMRFGKCANGKCHCYGG-amide | 2915 |
| GVIINVKCKISAQCL[Dpr]PCKDAGMRFGKCANGKCHCYGG-amide | 2916 |
| GVIINVKCKISAQCLKPCKDAGMRFGKCANGKCHCFGG-amide | 2917 |
| GVIINVKCKISAQCLKPCKDAGMRFGKCANGKCHCYG-amide | 2918 |
| GVIINVKCKISAQCLKPCKDAGMRFGKCANGKCACYG-amide | 2919 |
| GVIINVKCKISAQCLOPCKDAGMRFGKCANGKCACYGG-amide | 2920 |
| GVIINVKCKISAQCL[hLys]PCKDAGMRFGKCANGKCACYGG-amide | 2921 |
| GVIINVKCKISAQCL[hArg]PCKDAGMRFGKCANGKCACYGG-amide | 2922 |
| GVIINVKCKISAQCL[Cit]PCKDAGMRFGKCANGKCACYGG-amide | 2923 |
| GVIINVKCKISAQCL[hCit]PCKDAGMRFGKCANGKCACYGG-amide | 2924 |
| GVIINVKCKISAQCL[Dpr]PCKDAGMRFGKCANGKCACYGG-amide | 2925 |
| GVIINVKCKISAQCL[Dab]PCKDAGMRFGKCANGKCACYGG-amide | 2926 |
| GVIINVKCKISAQCLKPCKDAGMRFGKCANGKCACYGG-amide | 2927 |
| GVIINVKCKISAQCLOPCKDAGMRFGKCANGKCHCGGG-amide | 2928 |
| GVIINVKCKISAQCL[hLys]PCKDAGMRFGKCANGKCHCGGG-amide | 2929 |
| GVIINVKCKISAQCL[hArg]PCKDAGMRFGKCANGKCHCGGG-amide | 2930 |
| GVIINVKCKISAQCL[Cit]PCKDAGMRFGKCANGKCHCGGG-amide | 2931 |
| GVIINVKCKISAQCL[hCit]PCKDAGMRFGKCANGKCHCGGG-amide | 2932 |
| GVIINVKCKISAQCL[Dpr]PCKDAGMRFGKCANGKCHCGGG-amide | 2933 |
| GVIINVKCKISAQCLKPCKDAGMRFGKCANGKCACGGG-amide | 2934 |
| GVIINVKCKISAQCLOPCKDAGMRFGKCANGKCACFGG-amide | 2935 |
| GVIINVKCKISAQCLOPCKDAGMRFGKCANGKCACGGG-amide | 2936 |
| GVIINVKCKISAQCL[hLys]PCKDAGMRFGKCANGKCACGGG-amide | 2937 |
| GVIINVKCKISAQCL[hArg]PCKDAGMRFGKCANGKCACGGG-amide | 2938 |
| GVIINVKCKISAQCL[Cit]PCKDAGMRFGKCANGKCACGGG-amide | 2939 |
| GVIINVKCKISAQCL[hCit]PCKDAGMRFGKCANGKCACGGG-amide | 2940 |
| GVIINVKCKISAQCL[Dpr]PCKDAGMRFGKCANGKCACGGG-amide | 2941 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCL[Dab]PCKDAGMRFGKCANGKCACGGG-amide | 2942 |
| GVIINVKCKISAQCLOPCKEAGMRFGKCANGKCHCTPK-amide | 2943 |
| GVIINVKCKISAQCL[hLys]PCKEAGMRFGKCANGKCHCTPK-amide | 2944 |
| GVIINVKCKISAQCL[hArg]PCKEAGMRFGKCANGKCHCTPK-amide | 2945 |
| GVIINVKCKISAQCL[Cit]PCKEAGMRFGKCANGKCHCTPK-amide | 2946 |
| GVIINVKCKISAQCL[hCit]PCKEAGMRFGKCANGKCHCTPK-amide | 2947 |
| GVIINVKCKISAQCL[Dpr]PCKEAGMRFGKCANGKCHCTPK-amide | 2948 |
| GVIINVKCKISAQCL[Dab]PCKEAGMRFGKCANGKCHCTPK-amide | 2949 |
| GVIINVKCKISAQCLOPCKEAGMRFGKCANGKCHCYPK-amide | 2950 |
| GVIINVKCKISAQCL[hLys]PCKEAGMRFGKCANGKCHCYPK-amide | 2951 |
| GVIINVKCKISAQCL[hArg]PCKEAGMRFGKCANGKCHCYPK-amide | 2952 |
| GVIINVKCKISAQCL[Cit]PCKEAGMRFGKCANGKCHCYPK-amide | 2953 |
| GVIINVKCKISAQCL[hCit]PCKEAGMRFGKCANGKCHCYPK-amide | 2954 |
| GVIINVKCKISAQCL[Dpr]PCKEAGMRFGKCANGKCHCYPK-amide | 2955 |
| GVIINVKCKISAQCL[Dab]PCKEAGMRFGKCANGKCHCYPK-amide | 2956 |
| GVIINVKCKISAQCLOPCKEAGMRFGKCANGKCACTPK-amide | 2957 |
| GVIINVKCKISAQCL[hLys]PCKEAGMRFGKCANGKCACTPK-amide | 2958 |
| GVIINVKCKISAQCL[hArg]PCKEAGMRFGKCANGKCACTPK-amide | 2959 |
| GVIINVKCKISAQCL[Cit]PCKEAGMRFGKCANGKCACTPK-amide | 2960 |
| GVIINVKCKISAQCL[hCit]PCKEAGMRFGKCANGKCACTPK-amide | 2961 |
| GVIINVKCKISAQCL[Dpr]PCKEAGMRFGKCANGKCACTPK-amide | 2962 |
| GVIINVKCKISAQCL[Dab]PCKEAGMRFGKCANGKCACTPK-amide | 2963 |
| GVIINVKCKISAQCLOPCKEAGMRFGKCANGKCHC-amide | 2964 |
| GVIINVKCKISAQCL[hLys]PCKEAGMRFGKCANGKCHC-amide | 2965 |
| GVIINVKCKISAQCL[hArg]PCKEAGMRFGKCANGKCHC-amide | 2966 |

TABLE 7D-continued

Additional useful OSK1 peptide analog sequences: Ala-12 & Ala29 Substituted Series

| Sequence/structure | SEQ ID NO: |
|---|---|
| GVIINVKCKISAQCL[Cit]PCKEAGMRFGKCANGKCHC-amide | 2967 |
| GVIINVKCKISAQCL[hCit]PCKEAGMRFGKCANGKCHC-amide | 2968 |
| GVIINVKCKISAQCL[Dpr]PCKEAGMRFGKCANGKCHC-amide | 2969 |
| GVIINVKCKISAQCLOPCKEAGMRFGKCANGKCAC-amide | 2970 |
| GVIINVKCKISAQCL[hLys]PCKEAGMRFGKCANGKCAC-amide | 2971 |
| GVIINVKCKISAQCL[hArg]PCKEAGMRFGKCANGKCAC-amide | 2972 |
| GVIINVKCKISAQCL[Cit]PCKEAGMRFGKCANGKCAC-amide | 2973 |
| GVIINVKCKISAQCL[hCit]PCKEAGMRFGKCANGKCHC-amide | 2974 |
| GVIINVKCKISAQCL[Dpr]PCKEAGMRFGKCANGKCAC-amide | 2975 |
| GVIINVKCKISAQCL[Dab]PCKEAGMRFGKCANGKCAC-amide | 2976 |
| GVIINVKCKISAQCLKPCKEAGMRFGKCANGKCHCWGG-amide | 2977 |
| GVIINVKCKISAQCLOPCKEAGMRFGKCANGKCHCYGG-amide | 2978 |
| GVIINVKCKISAQCL[hLys]PCKEAGMRFGKCANGKCHCYGG-amide | 2979 |
| GVIINVKCKISAQCL[hArg]PCKEAGMRFGKCANGKCHCYGG-amide | 2980 |
| GVIINVKCKISAQCL[Cit]PCKEAGMRFGKCANGKCHCYGG-amide | 2981 |
| GVIINVKCKISAQCL[hCit]PCKEAGMRFGKCANGKCHCYGG-amide | 2982 |
| GVIINVKCKISAQCL[Dpr]PCKEAGMRFGKCANGKCHCYGG-amide | 2983 |
| GVIINVKCKISAQCL[Dab]PCKEAGMRFGKCANGKCHCYGG-amide | 2984 |
| GVIINVKCKISAQCLKPCKEAGMRFGKCANGKCACYGG-amide | 2985 |
| GVIINVKCKISAQCLOPCKEAGMRFGKCANGKCACYGG-amide | 2986 |
| GVIINVKCKISAQCL[hLys]PCKEAGMRFGKCANGKCACYGG-amide | 2987 |
| GVIINVKCKISAQCL[hArg]PCKEAGMRFGKCANGKCACYGG-amide | 2988 |
| GVIINVKCKISAQCL[Cit]PCKEAGMRFGKCANGKCACYGG-amide | 2989 |
| GVIINVKCKISAQCL[hCit]PCKEAGMRFGKCANGKCHCYGG-amide | 2990 |
| GVIINVKCKISAQCL[Dpr]PCKEAGMRFGKCANGKCACYGG-amide | 2991 |
| GVIINVKCKISAQCL[Dab]PCKEAGMRFGKCANGKCACYGG-amide | 2992 |
| GVIINVKCKISAQCLOPCKEAGMRFGKCANGKCHCGGG-amide | 2993 |

TABLE 7D-continued

| Additional useful OSK1 peptide analog sequences: Ala-12 & Ala29 Substituted Series | |
|---|---|
| Sequence/structure | SEQ ID NO: |
| GVIINVKCKISAQCL[hLys]PCKEAGMRFGKCANGKCHCGGG-amide | 2994 |
| GVIINVKCKISAQCL[hArg]PCKEAGMRFGKCANGKCHCGGG-amide | 2995 |
| GVIINVKCKISAQCL[Cit]PCKEAGMRFGKCANGKCHCGGG-amide | 2996 |
| GVIINVKCKISAQCL[hCit]PCKEAGMRFGKCANGKCHCGGG-amide | 2997 |
| GVIINVKCKISAQCL[Dpr]PCKEAGMRFGKCANGKCHCGGG-amide | 2998 |
| GVIINVKCKISAQCLOPCKEAGMRFGKCANGKCACGGG-amide | 2999 |
| GVIINVKCKISAQCL[hLys]PCKEAGMRFGKCANGKCACGGG-amide | 3000 |
| GVIINVKCKISAQCL[hArg]PCKEAGMRFGKCANGKCACGGG-amide | 3001 |
| GVIINVKCKISAQCL[Cit]PCKEAGMRFGKCANGKCACGGG-amide | 3002 |
| GVIINVKCKISAQCL[hCit]PCKEAGMRFGKCANGKCACTP-amide | 3003 |
| GVIINVKCKISAQCL[Dpr]PCKEAGMRFGKCANGKCACGGG-amide | 3004 |
| GVIINVKCKISAQCL[Dab]PCKEAGMRFGKCANGKCACGGG-amide | 3005 |
| GVIINVKCKISAQCLKPCK[Cpa]AGMRFGKCANGKCACYGG-amide | 3006 |
| GVIINVKCKISAQCLKPCK[Cpa]AGMRFGKCANGKCACGGG-amide | 3007 |
| GVIINVKCKISAQCLKPCK[Cpa]AGMRFGKCANGKCACY-amide | 3008 |
| Ac-GVIINVKCKISAQCLKPCKDAGMRFGKCANGKCACYGG-amide | 3009 |
| GVIINVKCKISAQCLKPCK[Aad]AGMRFGKCANGKCACYGG-amide | 3010 |
| GVIINVKCKISAQCLKPCK[Aad]AGMRFGKCANGKCHCYGG-amide | 3011 |
| GVIINVKCKISAQCLKPCK[Aad]AGMRFGKCANGKCACYGG | 3012 |
| GVIINVKCKISAQCLHPCKDAGMRFGKCANGKCACYGG-amide | 3013 |
| CVIINVKCKISAQCLHPCKDAGMRFGKCANGKCACYGG | 3014 |
| GVIINVKCKISAQCLHPCKDAGMRFGKCANGKCACY-amide | 3015 |
| GVIINVKCKISAQCLHPCKDAGMRFGKCANGKCHCYGG-amide | 3016 |
| GVIINVKCKISAQCLHPCKDAGMRFGKCANGKCHCYGG | 3017 |
| GVIINVKCKISAQCLHPCKDAGMRFGKCANGKCHCYPK | 3018 |
| GVIINVKCKISAQCLHPCKDAGMRFGKCANGKCAC | 3019 |
| GVIINVKCKISAQCLKPCKDAGMRFGKCANGKCAC[1Nal]GG-amide | 3020 |
| GVIINVKCKISAQCLKPCKDAGMRFGKCANGKCAC[1Nal]PK-amide | 3021 |
| GVIINVKCKISAQCLKPCKDAGMRFGKCANGKCAC[2Nal]GG-amide | 3022 |
| GVIINVKCKISAQCLKPCKDAGMRFGKCANGKCAC[Cha]GG-amide | 3023 |
| GVIINVKCKISAQCLKPCKDAGMRFGKCANGKCAC[MePhe]GG-amide | 3024 |
| GVIINVKCKISAQCLKPCKDAGMRFGKCANGKCAC[BiPhA]GG-amide | 3025 |
| GVIINVKCKISAQCLKPCKDAGMRFGKCANGKC[Aib]CYGG-amide | 3026 |
| GVIINVKCKISAQCLKPCKDAGMRFGKCANGKC[Abu]CYGG-amide | 3027 |
| GVIINVKCKISAQCLKPCKDAGMRFGKCANGKCAC[1Nal] | 3028 |
| GVIINVKCKISAQCLHPCKDAGMRFGKCANGKCAC[1Nal]GG-amide | 3029 |
| GVIINVKCKISAQCLKPCKDAGMRFGKCANGKCAC[4Bip]-amide | 3030 |
| GVIINVKCKISAQCLHPCKDAGMRFGKCANGKCAC[4Bip]GG-amide | 3031 |
| GVIINVKCKISAQCLKPCKDAGMRFGKCANGKCHCGGG | 3032 |

TABLE 7E

| Additional useful OSK1 peptide analogs: Ala-12 & Ala30 Substituted Series | |
|---|---|
| Sequence/structure | SEQ ID NO: |
| GVIINVKCKISAQCLEPCKKAGMRFGKCMAGKCHCTPK | 3033 |
| GVIINVSCKISAQCLEPCKKAGMRFGKCMAGKCHCTPK | 3034 |
| GVIINVKCKISAQCLKPCKKAGMRFGKCMAGKCHCTPK | 3035 |
| GVIINVKCKISAQCLEPCKDAGMRFGKCMAGKCHCTPK | 3036 |
| GVIINVKCKISAQCLKPCKDAGMRFGKCMAGKCHCTPK | 3037 |
| GVIINVSCKISAQCLKPCKDAGMRFGKCMAGKCHCTPK | 3038 |
| GVIINVKCKISPQCLKPCKDAGMRFGKCMAGKCHCTPK | 3039 |
| GVIINVKCKISAQCLKPCKDAGMRFGKCMAGKCHCYPK | 3040 |
| Ac-GVIINVKCKISPQCLKPCKDAGMRFGKCMAGKCHCTPK | 3041 |
| GVIINVKCKISPQCLKPCKDAGMRFGKCMAGKCHCTPK-amide | 3042 |
| Ac-GVIINVKCKISPQCLKPCKDAGMRFGKCMAGKCHCTPK-amide | 3043 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLKPCKDAGMRFGKCMAGKCHCYPK-amide | 3044 |
| Ac-GVIINVKCKISAQCLKPCKDAGMRFGKCMAGKCHCYPK | 3045 |
| Ac-GVIINVKCKISAQCLKPCKDAGMRFGKCMAGKCHCYPK-amide | 3046 |
| GVIINVKCKISAQCLKPCKKAGMRFGKCMAGKCHCTPK-amide | 3047 |
| Ac-GVIINVKCKISAQCLKPCKKAGMRFGKCMAGKCHCTPK | 3048 |
| Ac-GVIINVKCKISAQCLKPCKKAGMRFGKCMAGKCHCTPK-amide | 3049 |
| Ac-GVIINVKCKISAQCLEPCKDAGMRFGKCMAGKCHCTPK | 3050 |
| GVIINVKCKISAQCLEPCKDAGMRFGKCMAGKCHCTPK-amide | 3051 |
| Ac-GVIINVKCKISAQCLEPCKDAGMRFGKCMAGKCHCTPK-amide | 3052 |
| GVIINVKCKISAQCLEPCKKAGMRFGKCMAGKCHCTPK-amide | 3053 |
| Ac-GVIINVKCKISAQCLEPCKKAGMRFGKCMAGKCHCTPK | 3054 |
| Ac-GVIINVKCKISAQCLEPCKKAGMRFGKCMAGKCHCTPK-amide | 3055 |
| GVIINVKCKISAQCLKPCKDAGMRFGKCMAGKCHCTPK-amide | 3056 |
| Ac-GVIINVKCKISAQCLKPCKDAGMRFGKCMAGKCHCTPK | 3057 |
| Ac-GVIINVKCKISAQCLKPCKDAGMRFGKCMAGKCHCTPK-amide | 3058 |
| VIINVKCKISAQCLEPCKKAGMRFGKCMAGKCHCTPK | 3059 |
| Ac-VIINVKCKISAQCLEPCKKAGMRFGKCMAGKCHCTPK | 3060 |
| VIINVKCKISAQCLEPCKKAGMRFGKCMAGKCHCTPK-amide | 3061 |
| Ac-VIINVKCKISAQCLEPCKKAGMRFGKCMAGKCHCTPK-amide | 3062 |
| GVIINVKCKISAQCLEPCKKAGMRFGKCMAGKCACTPK | 3063 |
| Ac-GVIINVKCKISAQCLEPCKKAGMRFGKCMAGKCACTPK | 3064 |
| GVIINVKCKISAQCLEPCKKAGMRFGKCMAGKCACTPK-amide | 3065 |
| Ac-GVIINVKCKISAQCLEPCKKAGMRFGKCMAGKCACTPK-amide | 3066 |
| VIINVKCKISAQCLKPCKDAGMRFGKCMAGKCHCTPK | 3067 |
| Ac-VIINVKCKISAQCLKPCKDAGMRFGKCMAGKCHCTPK | 3068 |
| VIINVKCKISAQCLKPCKDAGMRFGKCMAGKCHCTPK-amide | 3069 |
| Ac-VIINVKCKISAQCLKPCKDAGMRFGKCMAGKCHCTPK-amide | 3070 |
| NVKCKISAQCLKPCKDAGMRFGKCMAGKCHCTPK | 3071 |
| Ac-NVKCKISAQCLKPCKDAGMRFGKCMAGKCHCTPK | 3072 |
| NVKCKISAQCLKPCKDAGMRFGKCMAGKCHCTPK-amide | 3073 |
| Ac-NVKCKISAQCLKPCKDAGMRFGKCMAGKCHCTPK-amide | 3074 |
| KCKISAQCLKPCKDAGMRFGKCMAGKCHCTPK | 3075 |
| Ac-KCKISAQCLKPCKDAGMRFGKCMAGKCHCTPK | 3076 |
| KCKISAQCLKPCKDAGMRFGKCMAGKCHCTPK-amide | 3077 |
| Ac-KCKISAQCLKPCKDAGMRFGKCMAGKCHCTPK-amide | 3078 |
| CKISAQCLKPCKDAGMRFGKCMAGKCHCTPK | 3079 |
| Ac-CKISAQCLKPCKDAGMRFGKCMAGKCHCTPK | 3080 |
| CKISAQCLKPCKDAGMRFGKCMAGKCHCTPK-amide | 3081 |
| Ac-CKISAQCLKPCKDAGMRFGKCMAGKCHCTPK-amide | 3082 |
| GVIINVKCKISAQCLKPCKDAGMRNGKCMAGKCHCTPK | 3083 |
| GVIINVKCKISAQCLKPCKDAGMRNGKCMAGKCHCTPK-amide | 3084 |
| Ac-GVIINVKCKISAQCLKPCKDAGMRNGKCMAGKCHCTPK | 3085 |
| Ac-GVIINVKCKISAQCLKPCKDAGMRNGKCMAGKCHCTPK-amide | 3086 |
| GVIINVKCKISAQCLKPCKDAGMRFGKCMNRKCHCTPK | 3087 |
| GVIINVKCKISAQCLKPCKDAGMRFGKCMNRKCHCTPK-amide | 3088 |
| Ac-GVIINVKCKISAQCLKPCKDAGMRFGKCMNRKCHCTPK | 3089 |
| Ac-GVIINVKCKISAQCLKPCKDAGMRFGKCMNRKCHCTPK-amide | 3090 |
| GVIINVKCKISKQCLKPCRDAGMRFGKCMAGKCHCTPK | 3091 |
| Ac-GVIINVKCKISKQCLKPCRDAGMRFGKCMAGKCHCTPK | 3092 |
| GVIINVKCKISKQCLKPCRDAGMRFGKCMAGKCHCTPK-amide | 3093 |
| Ac-GVIINVKCKISKQCLKPCRDAGMRFGKCMAGKCHCTPK-amide | 3094 |
| TIINVKCKISAQCLKPCKDAGMRFGKCMAGKCHCTPK | 3095 |
| Ac-TIINVKCKISAQCLKPCKDAGMRFGKCMAGKCHCTPK | 3096 |
| TIINVKCKISAQCLKPCKDAGMRFGKCMAGKCHCTPK-amide | 3097 |
| Ac-TIINVKCKISAQCLKPCKDAGMRFGKCMAGKCHCTPK-amide | 3098 |
| GVKINVKCKISAQCLEPCKKAGMRFGKCMAGKCHCTPK | 3099 |
| Ac-GVKINVKCKISAQCLEPCKKAGMRFGKCMAGKCHCTPK | 3100 |
| GVKINVKCKISAQCLEPCKKAGMRFGKCMAGKCHCTPK-amide | 3101 |
| Ac-GVKINVKCKISAQCLEPCKKAGMRFGKCMAGKCHCTPK-amide | 3102 |
| GVKINVKCKISAQCLEPCKKAGMRFGKCMAGKCACTPK | 3103 |
| GVKINVKCKISAQCLKPCKDAGMRFGKCMAGKCHCTPK | 3104 |
| GVKINVKCKISAQCLKPCKDAGMRFGKCMAGKCACTPK | 3105 |
| Ac-GVKINVKCKISAQCLEPCKKAGMRFGKCMAGKCACTPK | 3106 |
| GVKINVKCKISAQCLEPCKKAGMRFGKCMAGKCACTPK-amide | 3107 |

TABLE 7E-continued

Additional useful OSK1 peptide analogs: Ala-12 & Ala30 Substituted Series

| Sequence/structure | SEQ ID NO: |
|---|---|
| Ac-GVKINVKCKISAQCLEPCKKAGMRFGKCMAGKCACTPK-amide | 3108 |
| Ac-GVKINVKCKISAQCLKPCKDAGMRFGKCMAGKCACTPK | 3109 |
| GVKINVKCKISAQCLKPCKDAGMRFGKCMAGKCACTPK-amide | 3110 |
| Ac-GVKINVKCKISAQCLKPCKDAGMRFGKCMAGKCACTPK-amide | 3111 |
| Ac-GVKINVKCKISAQCLKPCKDAGMRFGKCMAGKCHCTPK | 3112 |
| GVKINVKCKISAQCLKPCKDAGMRFGKCMAGKCHCTPK-amide | 3113 |
| Ac-GVKINVKCKISAQCLKPCKDAGMRFGKCMAGKCHCTPK-amide | 3114 |
| GVIINVKCKISAQCLKPCKDAGMRFGKCMAGKCHCT | 3115 |
| GVIINVKCKISAQCLOPCKDAGMRFGKCMAGKCHCTPK | 3116 |
| GVIINVKCKISAQCL[hLys]PCKDAGMRFGKCMAGKCHCTPK | 3117 |
| GVIINVKCKISAQCL[hArq]PCKDAGMRFGKCMAGKCHCTPK | 3118 |
| GVIINVKCKISAQCL[Cit]PCKDAGMRFGKCMAGKCHCTPK | 3119 |
| GVIINVKCKISAQCL[hCit]PCKDAGMRFGKCMAGKCHCTPK | 3120 |
| GVIINVKCKISAQCL[Dpr]PCKDAGMRFGKCMAGKCHCTPK | 3121 |
| GVIINVKCKISAQCL[Dab]PCKDAGMRFGKCMAGKCHCTPK | 3122 |
| GVIINVKCKISAQCLOPCKDAGMRFGKCMAGKCHCYPK | 3123 |
| GVIINVKCKISAQCL[hLys]PCKDAGMRFGKCMAGKCHCYPK | 3124 |
| GVIINVKCKISAQCL[hArg]PCKDAGMRFGKCMAGKCHCYPK | 3125 |
| GVIINVKCKISAQCL[Cit]PCKDAGMRFGKCMAGKCHCYPK | 3126 |
| GVIINVKCKISAQCL[hCit]PCKDAGMRFGKCMAGKCHCYPK | 3127 |
| GVIINVKCKISAQCL[Dpr]PCKDAGMRFGKCMAGKCHCYPK | 3128 |
| GVIINVKCKISAQCL[Dab]PCKDAGMRFGKCMAGKCHCYPK | 3129 |
| GVIINVKCKISAQCLKPCKDAGMRFGKCMAGKCACYPK | 3130 |
| GVIINVKCKISAQCLKPCKDAGMRFGKCMAGKCGCYPK | 3131 |
| GVIINVKCKISAQCLKPCKDAGMRFGKCMAGKCACFPK | 3132 |
| GVIINVKCKISAQCLKPCKDAGMRFGKCMAGKCACWPK | 4920 |
| GVIINVKCKISAQCLKPCKEAGMRFGKCMAGKCACYPK | 4921 |
| GVIINVKCKISAQCLOPCKDAGMRFGKCMAGKCACTPK | 4922 |
| GVIINVKCKISAQCL[hLys]PCKDAGMRFGKCMAGKCACTPK | 4923 |
| GVIINVKCKISAQCL[hArg]PCKDAGMRFGKCMAGKCACTPK | 4924 |
| GVIINVKCKISAQCL[Cit]PCKDAGMRFGKCMAGKCACTPK | 4925 |
| GVIINVKCKISAQCL[hCit]PCKDAGMRFGKCMAGKCHCTPK | 4926 |
| GVIINVKCKISAQCL[Dpr]PCKDAGMRFGKCMAGKCACTPK | 4927 |
| GVIINVKCKISAQCL[Dab]PCKDAGMRFGKCMAGKCACTPK | 4928 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLOPCKDAGMRFGKCMAGKCHC | 4929 |
| GVIINVKCKISAQCL[hLys]PCKDAGMRFGKCMAGKCHC | 3133 |
| GVIINVKCKISAQCL[hArq]PCKDAGMRFGKCMAGKCHC | 3134 |
| GVIINVKCKISAQCL[Cit]PCKDAGMRFGKCMAGKCHC | 3135 |
| GVIINVKCKISAQCL[hCit]PCKDAGMRFGKCMAGKCHC | 3136 |
| GVIINVKCKISAQCL[Dpr]PCKDAGMRFGKCMAGKCHC | 3137 |
| GVIINVKCKISAQCL[Dab]PCKDAGMRFGKCMAGKCHC | 3138 |
| GVIINVKCKISAQCLOPCKDAGMRFGKCMAGKCAC | 3139 |
| GVIINVKCKISAQCL[hLys]PCKDAGMRFGKCMAGKCAC | 3140 |
| GVIINVKCKISAQCL[hArg]PCKDAGMRFGKCMAGKCAC | 3141 |
| GVIINVKCKISAQCL[Cit]PCKDAGMRFGKCMAGKCAC | 3142 |
| GVIINVKCKISAQCL[hCit]PCKDAGMRFGKCMAGKCHC | 3143 |
| GVIINVKCKISAQCL[Dpr]PCKDAGMRFGKCMAGKCAC | 3144 |
| GVIINVKCKISAQCL[Dab]PCKDAGMRFGKCMAGKCAC | 3145 |
| GVIINVKCKISAQCLKPCKDAGMRFGKCMAGKCGCYGG | 3146 |
| GVIINVKCKISAQCLOPCKDAGMRFGKCMAGKCHCYGG | 3147 |
| GVIINVKCKISAQCL[hLys]PCKDAGMRFGKCMAGKCHCYGG | 3148 |
| GVIINVKCKISAQCL[hArg]PCKDAGMRFGKCMAGKCHCYGG | 3149 |
| GVIINVKCKISAQCL[Cit]PCKDAGMRFGKCMAGKCHCYGG | 3150 |
| GVIINVKCKISAQCL[hCit]PCKDAGMRFGKCMAGKCHCYGG | 3151 |
| GVIINVKCKISAQCL[Dpr]PCKDAGMRFGKCMAGKCHCYGG | 3152 |
| GVIINVKCKISAQCLKPCKDAGMRFGKCMAGKCACYGG | 3153 |
| GVIINVKCKISAQCLOPCKDAGMRFGKCMAGKCACYGG | 3154 |
| GVIINVKCKISAQCL[hLys]PCKDAGMRFGKCMAGKCACYGG | 3155 |
| GVIINVKCKISAQCL[hArg]PCKDAGMRFGKCMAGKCACYGG | 3156 |
| GVIINVKCKISAQCL[Cit]PCKDAGMRFGKCMAGKCACYGG | 3157 |
| GVIINVKCKISAQCL[hCit]PCKDAGMRFGKCMAGKCHCYGG | 3158 |
| GVIINVKCKISAQCL[Dpr]PCKDAGMRFGKCMAGKCACYGG | 3159 |
| GVIINVKCKISAQCL[Dab]PCKDAGMRFGKCMAGKCACYGG | 3160 |
| GVIINVKCKISAQCLKPCKDAGMRFGKCMAGKCACYG | 3161 |
| GVIINVKCKISAQCLOPCKDAGMRFGKCMAGKCHCGGG | 3162 |
| GVIINVKCKISAQCL[hLys]PCKDAGMRFGKCMAGKCHCGGG | 3163 |
| GVIINVKCKISAQCL[hArg]PCKDAGMRFGKCMAGKCHCGGG | 3164 |
| GVIINVKCKISAQCL[Cit]PCKDAGMRFGKCMAGKCHCGGG | 3165 |
| GVIINVKCKISAQCL[hCit]PCKDAGMRFGKCMAGKCHCGGG | 3166 |
| GVIINVKCKISAQCL[Dpr]PCKDAGMRFGKCMAGKCHCGGG | 3167 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLKPCKDAGMRFGKCMAGKCACFGG | 3168 |
| GVIINVKCKISAQCLOPCKDAGMRFGKCMAGKCACGGG | 3169 |
| GVIINVKCKISAQCL[hLys]PCKDAGMRFGKCMAGKCACGGG | 3170 |
| GVIINVKCKISAQCL[hArg]PCKDAGMRFGKCMAGKCACGGG | 3171 |
| GVIINVKCKISAQCL[Cit]PCKDAGMRFGKCMAGKCACGGG | 3172 |
| GVIINVKCKISAQCL[hCit]PCKDAGMRFGKCMAGKCACGGG | 3173 |
| GVIINVKCKISAQCL[Dpr]PCKDAGMRFGKCMAGKCACGGG | 3174 |
| GVIINVKCKISAQCL[Dab]PCKDAGMRFGKCMAGKCACGGG | 3175 |
| GVIINVKCKISAQCLKPCKDAGMRFGKCMAGKCACGG | 3176 |
| GVIINVKCKISAQCLKPCKDAGMRFGKCMAGKCACYG | 3177 |
| GVIINVKCKISAQCLOPCKDAGMRFGKCMAGKCACGG | 3178 |
| GVIINVKCKISAQCL[hLys]PCKEAGMRFGKCMAGKCHCTPK | 3179 |
| GVIINVKCKISAQCL[hArg]PCKEAGMRFGKCMAGKCHCTPK | 3180 |
| GVIINVKCKISAQCL[Cit]PCKEAGMRFGKCMAGKCHCTPK | 3181 |
| GVIINVKCKISAQCL[hCit]PCKEAGMRFGKCMAGKCHCTPK | 3182 |
| GVIINVKCKISAQCL[Dpr]PCKEAGMRFGKCMAGKCHCTPK | 3183 |
| GVIINVKCKISAQCL[Dab]PCKEAGMRFGKCMAGKCHCTPK | 3184 |
| GVIINVKCKISAQCLOPCKEAGMRFGKCMAGKCHCYPK | 3185 |
| GVIINVKCKISAQCL[hLys]PCKEAGMRFGKCMAGKCHCYPK | 3186 |
| GVIINVKCKISAQCL[hArq]PCKEAGMRFGKCMAGKCHCYPK | 3187 |
| GVIINVKCKISAQCL[Cit]PCKEAGMRFGKCMAGKCHCYPK | 3188 |
| GVIINVKCKISAQCL[hCit]PCKEAGMRFGKCMAGKCHCYPK | 3189 |
| GVIINVKCKISAQCL[Dpr]PCKEAGMRFGKCMAGKCHCYPK | 3190 |
| GVIINVKCKISAQCL[Dab]PCKEAGMREGKCMAGKCHCYPK | 3191 |
| GVIINVKCKISAQCLOPCKEAGMRFGKCMAGKCACTPK | 3192 |
| GVIINVKCKISAQCL[hLys]PCKEAGMRFGKCMAGKCACTPK | 3193 |
| GVIINVKCKISAQCL[hArg]PCKEAGMRFGKCMAGKCACTPK | 3194 |
| GVIINVKCKISAQCL[Cit]PCKEAGMRFGKCMAGKCACTPK | 3195 |
| GVIINVKCKISAQCL[hCit]PCKEAGMRFGKCMAGKCHCTPK | 3196 |
| GVIINVKCKISAQCL[Dpr]PCKEAGMRFGKCMAGKCACTPK | 3197 |
| GVIINVKCKISAQCL[Dab]PCKEAGMRFGKCMAGKCACTPK | 3198 |
| GVIINVKCKISAQCLOPCKEAGMRFGKCMAGKCHC | 3199 |
| GVIINVKCKISAQCL[hLys]PCKEAGMRFGKCMAGKCHC | 3200 |
| GVIINVKCKISAQCL[hArg]PCKEAGMRFGKCMAGKCHC | 3201 |
| GVIINVKCKISAQCL[Cit]PCKEAGMRFGKCMAGKCHC | 3202 |
| GVIINVKCKISAQCL[hCit]PCKEAGMRFGKCMAGKCHC | 3203 |
| GVIINVKCKISAQCL[Dpr]PCKEAGMRFGKCMAGKCHC | 3204 |
| GVIINVKCKISAQCLOPCKEAGMRFGKCMAGKCAC | 3205 |
| GVIINVKCKISAQCL[hLys]PCKEAGMRFGKCMAGKCAC | 3206 |
| GVIINVKCKISAQCL[hArg]PCKEAGMRFGKCMAGKCAC | 3207 |
| GVIINVKCKISAQCL[Cit]PCKEAGMRFGKCMAGKCAC | 3208 |
| GVIINVKCKISAQCL[hCit]PCKEAGMRFGKCMAGKCHC | 3209 |
| GVIINVKCKISAQCL[Dpr]PCKEAGMRFGKCMAGKCAC | 3210 |
| GVIINVKCKISAQCL[Dab]PCKEAGMRFGKCMAGKCAC | 3211 |
| GVIINVKCKISAQCLKPCKEAGMRFGKCMAGKCHCYGG | 3212 |
| GVIINVKCKISAQCLOPCKEAGMRFGKCMAGKCHCYGG | 3213 |
| GVIINVKCKISAQCLKPCKEAGMRFGKCMAGKCHCYG | 3214 |
| GVIINVKCKISAQCLKPCKEAGMRFGKCMAGKCACYG | 3215 |
| GVIINVKCKISAQCL[hLys]PCKEAGMRFGKCMAGKCHCYGG | 3216 |
| GVIINVKCKISAQCL[hArg]PCKEAGMRFGKCMAGKCHCYGG | 3217 |
| GVIINVKCKISAQCL[Cit]PCKEAGMRFGKCMAGKCHCYGG | 3218 |
| GVIINVKCKISAQCL[hCit]PCKEAGMRFGKCMAGKCHCYGG | 3219 |
| GVIINVKCKISAQCL[Dpr]PCKEAGMRFGKCMAGKCHCYGG | 3220 |
| GVIINVKCKISAQCL[Dab]PCKEAGMRFGKCMAGKCHCYGG | 3221 |
| GVIINVKCKISAQCLKPCKEAGMRFGKCMAGKCACYG | 3222 |
| GVIINVKCKISAQCLOPCKEAGMRFGKCMAGKCACYGG | 3223 |
| GVIINVKCKISAQCL[hLys]PCKEAGMRFGKCMAGKCACYGG | 3224 |
| GVIINVKCKISAQCL[hArg]PCKEAGMRFGKCMAGKCACYGG | 3225 |
| GVIINVKCKISAQCL[Cit]PCKEAGMRFGKCMAGKCACYGG | 3226 |
| GVIINVKCKISAQCL[hCit]PCKEAGMRFGKCMAGKCHCYGG | 3227 |
| GVIINVKCKISAQCL[Dpr]PCKEAGMRFGKCMAGKCACYGG | 3228 |
| GVIINVKCKISAQCL[Dab]PCKEAGMRFGKCMAGKCACYGG | 3229 |
| GVIINVKCKISAQCLKPCKEAGMRFGKCMAGKCACFGG | 3230 |
| GVIINVKCKISAQCLOPCKEAGMRFGKCMAGKCHCGGG | 3231 |
| GVIINVKCKISAQCL[hLys]PCKEAGMRFGKCMAGKCHCGGG | 3232 |
| GVIINVKCKISAQCL[hArq]PCKEAGMRFGKCMAGKCHCGGG | 3233 |
| GVIINVKCKISAQCL[Cit]PCKEAGMRFGKCMAGKCHCGGG | 3234 |
| GVIINVKCKISAQCL[hCit]PCKEAGMRFGKCMAGKCHCGGG | 3235 |
| GVIINVKCKISAQCL[Dpr]PCKEAGMRFGKCMAGKCHCGGG | 3236 |
| GVIINVKCKISAQCLOPCKEAGMRFGKCMAGKCACGGG | 3237 |
| GVIINVKCKISAQCL[hLys]PCKEAGMRFGKCMAGKCACGGG | 3238 |

TABLE 7E-continued

Additional useful OSK1 peptide analogs: Ala-12 & Ala30 Substituted Series

| Sequence/structure | SEQ ID NO: |
|---|---|
| GVIINVKCKISAQCL[hArg]PCKEAGMRFGKCMAGKCACGGG | 3239 |
| GVIINVKCKISAQCL[Cit]PCKEAGMRFGKCMAGKCACGGG | 3240 |
| GVIINVKCKISAQCL[hCit]PCKEAGMRFGKCMAGKCACTP | 3241 |
| GVIINVKCKISAQCL[Dpr]PCKEAGMRFGKCMAGKCACTP | 3242 |
| GVIINVKCKISAQCL[Dab]PCKEAGMRFGKCMAGKCACTP | 3243 |
| GVIINVKCKISAQCLOPCKDAGMRFGKCMAGKCHCTPK-amide | 3244 |
| GVIINVKCKISAQCL[hLys]PCKDAGMRFGKCMAGKCHCTPK-amide | 3245 |
| GVIINVKCKISAQCL[hArg]PCKDAGMRFGKCMAGKCHCTPK-amide | 3246 |
| GVIINVKCKISAQCL[Cit]PCKDAGMRFGKCMAGKCHCTPK-amide | 3247 |
| GVIINVKCKISAQCL[hCit]PCKDAGMRFGKCMAGKCHCTPK-amide | 3248 |
| GVIINVKCKISAQCL[Dpr]PCKDAGMRFGKCMAGKCHCTPK-amide | 3249 |
| GVIINVKCKISAQCL[Dab]PCKDAGMRFGKCMAGKCHCTPK-amide | 3250 |
| GVIINVKCKISAQCLOPCKDAGMRFGKCMAGKCHCYPK-amide | 3251 |
| GVIINVKCKISAQCL[hLys]PCKDAGMRFGKCMAGKCHCYPK-amide | 3252 |
| GVIINVKCKISAQCL[hArg]PCKDAGMRFGKCMAGKCHCYPK-amide | 3253 |
| GVIINVKCKISAQCL[Cit]PCKDAGMRFGKCMAGKCHCYPK-amide | 3254 |
| GVIINVKCKISAQCL[hCit]PCKDAGMRFGKCMAGKCHCYPK-amide | 3255 |
| GVIINVKCKISAQCL[Dpr]PCKDAGMRFGKCMAGKCHCYPK-amide | 3256 |
| GVIINVKCKISAQCL[Dab]PCKDAGMRFGKCMAGKCHCYPK-amide | 3257 |
| GVIINVKCKISAQCLOPCKDAGMRFGKCMAGKCACTPK-amide | 3258 |
| GVIINVKCKISAQCL[hLys]PCKDAGMRFGKCMAGKCACTPK-amide | 3259 |
| GVIINVKCKISAQCL[hArg]PCKDAGMRFGKCMAGKCACTPK-amide | 3260 |
| GVIINVKCKISAQCL[Cit]PCKDAGMRFGKCMAGKCACTPK-amide | 3261 |
| GVIINVKCKISAQCL[hCit]PCKDAGMRFGKCMAGKCACTPK-amide | 3262 |
| GVIINVKCKISAQCL[Dpr]PCKDAGMRFGKCMAGKCACTPK-amide | 3263 |
| GVIINVKCKISAQCL[Dab]PCKDAGMRFGKCMAGKCACTPK-amide | 3264 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLOPCKDAGMRFGKCMAGKCHC-amide | 3265 |
| GVIINVKCKISAQCL[hLys]PCKDAGMRFGKCMAGKCHC-amide | 3266 |
| GVIINVKCKISAQCL[hArq]PCKDAGMRFGKCMAGKCHC-amide | 3267 |
| GVIINVKCKISAQCL[Cit]PCKDAGMRFGKCMAGKCHC-amide | 3268 |
| GVIINVKCKISAQCL[hCit]PCKDAGMRFGKCMAGKCHC-amide | 3269 |
| GVIINVKCKISAQCL[Dpr]PCKDAGMRFGKCMAGKCHC-amide | 3270 |
| GVIINVKCKISAQCLOPCKDAGMRFGKCMAGKCAC-amide | 3271 |
| GVIINVKCKISAQCL[hLys]PCKDAGMRFGKCMAGKCAC-amide | 3272 |
| GVIINVKCKISAQCL[hArg]PCKDAGMRFGKCMAGKCAC-amide | 3273 |
| GVIINVKCKISAQCL[Cit]PCKDAGMRFGKCMAGKCAC-amide | 3274 |
| GVIINVKCKISAQCL[hCit]PCKDAGMRFGKCMAGKCHC-amide | 3275 |
| GVIINVKCKISAQCL[Dpr]PCKDAGMRFGKCMAGKCAC-amide | 3276 |
| GVIINVKCKISAQCL[Dab]PCKDAGMRFGKCMAGKCAC-amide | 3277 |
| GVIINVKCKISAQCLKPCKDAGMRFGKCMAGKCHCYGG-amide | 3278 |
| GVIINVKCKISAQCLOPCKDAGMRFGKCMAGKCHCYGG-amide | 3279 |
| GVIINVKCKISAQCL[hLys]PCKDAGMRFGKCMAGKCHCYGG-amide | 3280 |
| GVIINVKCKISAQCL[hArg]PCKDAGMRFGKCMAGKCHCYGG-amide | 3281 |
| GVIINVKCKISAQCL[Cit]PCKDAGMRFGKCMAGKCHCYGG-amide | 3282 |
| GVIINVKCKISAQCL[hCit]PCKDAGMRFGKCMAGKCHCYGG-amide | 3283 |
| GVIINVKCKISAQCL[Dpr]PCKDAGMRFGKCMAGKCHCYGG-amide | 3284 |
| GVIINVKCKISAQCLKPCKDAGMRFGKCMAGKCHCFGG-amide | 3285 |
| GVIINVKCKISAQCLKPCKDAGMRFGKCMAGKCHCYG-amide | 3286 |
| GVIINVKCKISAQCLKPCKDAGMRFGKCMAGKCACYG-amide | 3287 |
| GVIINVKCKISAQCLOPCKDAGMRFGKCMAGKCACYGC-amide | 3288 |
| GVIINVKCKISAQCL[hLys]PCKDAGMRFGKCMAGKCACYGG-amide | 3289 |
| GVIINVKCKISAQCL[hArg]PCKDAGMRFGKCMAGKCACYGG-amide | 3290 |
| GVIINVKCKISAQCL[Cit]PCKDAGMRFGKCMAGKCACYGG-amide | 3291 |

TABLE 7E-continued

Additional useful OSK1 peptide analogs: Ala-12 & Ala30 Substituted Series

| Sequence/structure | SEQ ID NO: |
|---|---|
| GVIINVKCKISAQCL[hCit]PCKDAGMRFGKCMAGKCACYGG-amide | 3292 |
| GVIINVKCKISAQCL[Dpr]PCKDAGMRFGKCMAGKCACYGG-amide | 3293 |
| GVIINVKCKISAQCL[Dab]PCKDAGMRFGKCMAGKCACYGG-amide | 3294 |
| GVIINVKCKISAQCLKPCKDAGMRFGKCMAGKCACYGG-amide | 3295 |
| GVIINVKCKISAQCLOPCKDAGMRFGKCMAGKCHCGGG-amide | 3296 |
| GVIINVKCKISAQCL[hLys]PCKDAGMRFGKCMAGKCHCGGG-amide | 3297 |
| GVIINVKCKISAQCL[hArg]PCKDAGMRFGKCMAGKCHCGGG-amide | 3298 |
| GVIINVKCKISAQCL[Cit]PCKDAGMRFGKCMAGKCHCGGG-amide | 3299 |
| GVIINVKCKISAQCL[hCit]PCKDAGMRFGKCMAGKCHCGGG-amide | 3300 |
| GVIINVKCKISAQCL[Dpr]PCKDAGMRFGKCMAGKCHCGGG-amide | 3301 |
| GVIINVKCKISAQCLKPCKDAGMRFGKCMAGKCACGGG-amide | 3302 |
| GVIINVKCKISAQCLOPCKDAGMRFGKCMAGKCACFGG-amide | 3303 |
| GVIINVKCKISAQCLOPCKDAGMRFGKCMAGKCACGGG-amide | 3304 |
| GVIINVKCKISAQCL[hLys]PCKDAGMRFGKCMAGKCACGGG-amide | 3305 |
| GVIINVKCKISAQCL[hArg]PCKDAGMRFGKCMAGKCACGGG-amide | 3306 |
| GVIINVKCKISAQCL[Cit]PCKDAGMRFGKCMAGKCACGGG-amide | 3307 |
| GVIINVKCKISAQCL[hCit]PCKDAGMRFGKCMAGKCACGGG-amide | 3308 |
| GVIINVKCKISAQCL[Dpr]PCKDAGMRFGKCMAGKCACGGG-amide | 3309 |
| GVIINVKCKISAQCL[Dab]PCKDAGMRFGKCMAGKCACGGG-amide | 3310 |
| GVIINVKCKISAQCLOPCKEAGMRFGKCMAGKCHCTPK-amide | 3311 |
| GVIINVKCKISAQCL[hLys]PCKEAGMRFGKCMAGKCHCTPK-amide | 3312 |
| GVIINVKCKISAQCL[hArg]PCKEAGMRFGKCMAGKCHCTPK-amide | 3313 |
| GVIINVKCKISAQCL[Cit]PCKEAGMRFGKCMAGKCHCTPK-amide | 3314 |
| GVIINVKCKISAQCL[hCit]PCKEAGMRFGKCMAGKCHCTPK-amide | 3315 |
| GVIINVKCKISAQCL[Dpr]PCKEAGMRFGKCMAGKCHCTPK-amide | 3316 |
| GVIINVKCKISAQCL[Dab]PCKEAGMRFGKCMAGKCHCTPK-amide | 3317 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLOPCKEAGMRFGKCMAGKCHCYPK-amide | 3318 |
| GVIINVKCKISAQCL[hLys]PCKEAGMRFGKCMAGKCHCYPK-amide | 3319 |
| GVIINVKCKISAQCL[hArg]PCKEAGMRFGKCMAGKCHCYPK-amide | 3320 |
| GVIINVKCKISAQCL[Cit]PCKEAGMRFGKCMAGKCHCYPK-amide | 3321 |
| GVIINVKCKISAQCL[hCit]PCKEAGMRFGKCMAGKCHCYPK-amide | 3322 |
| GVIINVKCKISAQCL[Dpr]PCKEAGMRFGKCMAGKCHCYPK-amide | 3323 |
| GVIINVKCKISAQCL[Dab]PCKEAGMRFGKCMAGKCHCYPK-amide | 3324 |
| GVIINVKCKISAQCLOPCKEAGMRFGKCMAGKCACTPK-amide | 3325 |
| GVIINVKCKISAQCL[hLys]PCKEAGMRFGKCMAGKCACTPK-amide | 3326 |
| GVIINVKCKISAQCL[hArg]PCKEAGMRFGKCMAGKCACTPK-amide | 3327 |
| GVIINVKCKISAQCL[Cit]PCKEAGMRFGKCMAGKCACTPK-amide | 3328 |
| GVIINVKCKISAQCL[hCit]PCKEAGMRFGKCMAGKCACTPK-amide | 3329 |
| GVIINVKCKISAQCL[Dpr]PCKEAGMRFGKCMAGKCACTPK-amide | 3330 |
| GVIINVKCKISAQCL[Dab]PCKEAGMRFGKCMAGKCACTPK-amide | 3331 |
| GVIINVKCKISAQCLOPCKEAGMRFGKCMAGKCHC-amide | 3332 |
| GVIINVKCKISAQCL[hLys]PCKEAGMRFGKCMAGKCHC-amide | 3333 |
| GVIINVKCKISAQCL[hArg]PCKEAGMRFGKCMAGKCHC-amide | 3334 |
| GVIINVKCKISAQCL[Cit]PCKEAGMRFGKCMAGKCHC-amide | 3335 |
| GVIINVKCKISAQCL[hCit]PCKEAGMRFGKCMAGKCHC-amide | 3336 |
| GVIINVKCKISAQCL[Dpr]PCKEAGMRFGKCMAGKCHC-amide | 3337 |
| GVIINVKCKISAQCLOPCKEAGMRFGKCMAGKCAC-amide | 3338 |
| GVIINVKCKISAQCL[hLys]PCKEAGMRFGKCMAGKCAC-amide | 3339 |
| GVIINVKCKISAQCL[hArg]PCKEAGMRFGKCMAGKCAC-amide | 3340 |
| GVIINVKCKISAQCL[Cit]PCKEAGMRFGKCMAGKCAC-amide | 3341 |
| GVIINVKCKISAQCL[hCit]PCKEAGMRFGKCMAGKCHC-amide | 3342 |
| GVIINVKCKISAQCL[Dpr]PCKEAGMRFGKCMAGKCAC-amide | 3343 |

TABLE 7E-continued

Additional useful OSK1 peptide analogs: Ala-12 & Ala30 Substituted Series

| Sequence/structure | SEQ ID NO: |
|---|---|
| GVIINVKCKISAQCL[Dab]PCKEAGMRFGKCMAGKCAC-amide | 3344 |
| GVIINVKCKISAQCLKPCKEAGMRFGKCMAGKCHCWGG-amide | 3345 |
| GVIINVKCKISAQCLOPCKEAGMRFGKCMAGKCHCYGG-amide | 3346 |
| GVIINVKCKISAQCL[hLys]PCKEAGMRFGKCMAGKCHCYGG-amide | 3347 |
| GVIINVKCKISAQCL[hArg]PCKEAGMRFGKCMAGKCHCYGG-amide | 3348 |
| GVIINVKCKISAQCL[Cit]PCKEAGMRFGKCMAGKCHCYGG-amide | 3349 |
| GVIINVKCKISAQCL[hCit]PCKEAGMRFGKCMAGKCHCYGG-amide | 3350 |
| GVIINVKCKISAQCL[Dpr]PCKEAGMRFGKCMAGKCHCYGG-amide | 3351 |
| GVIINVKCKISAQCL[Dab]PCKEAGMRFGKCMAGKCHCYGG-amide | 3352 |
| GVIINVKCKISAQCLKPCKEAGMRFGKCMAGKCACYGG-amide | 3353 |
| GVIINVKCKISAQCLOPCKEAGMRFGKCMAGKCACYGG-amide | 3354 |
| GVIINVKCKISAQCL[hLys]PCKEAGMRFGKCMAGKCACYGG-amide | 3355 |
| GVIINVKCKISAQCL[hArg]PCKEAGMRFGKCMAGKCACYGG-amide | 3356 |
| GVIINVKCKISAQCL[Cit]PCKEAGMRFGKCMAGKCACYGG-amide | 3357 |
| GVIINVKCKISAQCL[hCit]PCKEAGMRFGKCMAGKCHCYGG-amide | 3358 |
| GVIINVKCKISAQCL[Dpr]PCKEAGMRFGKCMAGKCACYGG-amide | 3359 |
| GVIINVKCKISAQCL[Dab]PCKEAGMRFGKCMAGKCACYGG-amide | 3360 |
| GVIINVKCKISAQCLOPCKEAGMRFGKCMAGKCHCGGG-amide | 3361 |
| GVIINVKCKISAQCL[hLys]PCKEAGMRFGKCMAGKCHCGGG-amide | 3362 |
| GVIINVKCKISAQCL[hArg]PCKEAGMRFGKCMAGKCHCGGG-amide | 3363 |
| GVIINVKCKISAQCL[Cit]PCKEAGMRFGKCMAGKCHCGGG-amide | 3364 |
| GVIINVKCKISAQCL[hCit]PCKEAGMRFGKCMAGKCHCGGG-amide | 3365 |
| GVIINVKCKISAQCL[Dpr]PCKEAGMRFGKCMAGKCHCGGG-amide | 3366 |
| GVIINVKCKISAQCLOPCKEAGMRFGKCMAGKCACGGG-amide | 3367 |
| GVIINVKCKISAQCL[hLys]PCKEAGMRFGKCMAGKCACGGG-amide | 3368 |
| GVIINVKCKISAQCL[hArg]PCKEAGMRFGKCMAGKCACGGG-amide | 3369 |
| GVIINVKCKISAQCL[Cit]PCKEAGMRFGKCMAGKCACGGG-amide | 3370 |
| GVIINVKCKISAQCL[hCit]PCKEAGMRFGKCMAGKCACTP-amide | 3371 |
| GVIINVKCKISAQCL[Dpr]PCKEAGMRFGKCMAGKCACGGG-amide | 3372 |
| GVIINVKCKISAQCL[Dab]PCKEAGMRFGKCMAGKCACGGG-amide | 3373 |
| GVIINVKCKISAQCLKPCK[Cpa]AGMRFGKCMAGKCACYGG-amide | 3374 |
| GVIINVKCKISAQCLKPCK[Cpa]AGMRFGKCMAGKCACGGG-amide | 3375 |
| GVIINVKCKISAQCLKPCK[Cpa]AGMRFGKCMAGKCACY-amide | 3376 |
| Ac-GVIINVKCKISAQCLKPCKDAGMRFGKCMAGKCACYGG-amide | 3377 |
| GVIINVKCKISAQCLKPCK[Aad]AGMRFGKCMAGKCACYGG-amide | 3378 |
| GVIINVKCKISAQCLKPCK[Aad]AGMRFGKCMAGKCHCYGG-amide | 3379 |
| GVIINVKCKISAQCLKPCK[Aad]AGMRFGKCMAGKCACYGG | 3380 |
| GVIINVKCKISAQCLHPCKDAGMRFGKCMAGKCACYGG-amide | 3381 |
| GVIINVKCKISAQCLHPCKDAGMRFGKCMAGKCACYGG | 3382 |
| GVIINVKCKISAQCLHPCKDAGMRFGKCMAGKCACY-amide | 3383 |
| GVIINVKCKISAQCLHPCKDAGMRFGKCMAGKCHCYGG-amide | 3384 |
| GVIINVKCKISAQCLHPCKDAGMRFGKCMAGKCHCYGG | 3385 |
| GVIINVKCKISAQCLHPCKDAGMRFGKCMAGKCHCYPK | 3386 |
| GVIINVKCKISAQCLHPCKDAGMRFGKCMAGKCAC | 3387 |
| GVIINVKCKISAQCLKPCKDAGMRFGKCMAGKCAC[1Nal]GG-amide | 3388 |
| GVIINVKCKISAQCLKPCKDAGMRFGKCMAGKCAC[1Nal]PK-amide | 3389 |
| GVIINVKCKISAQCLKPCKDAGMRFGKCMAGKCAC[2Nal]GG-amide | 3390 |
| GVIINVKCKISAQCLKPCKDAGMRFGKCMAGKCAC[Cha]GG-amide | 3391 |
| GVIINVKCKISAQCLKPCKDAGMRFGKCMAGKCAC[MePhe]GG-amide | 3392 |
| GVIINVKCKISAQCLKPCKDAGMRFGKCMAGKCAC[BiPhA]GG-amide | 3393 |
| GVIINVKCKISAQCLKPCKDAGMRFGKCMAGKC[Aib]CYGG-amide | 3394 |
| GVIINVKCKISAQCLKPCKDAGMRFGKCMAGKC[Abu]CYGG-amide | 3395 |

TABLE 7E-continued

Additional useful OSK1 peptide analogs: Ala-12 & Ala30 Substituted Series

| Sequence/structure | SEQ ID NO: |
|---|---|
| GVIINVKCKISAQCLKPCKDAGMRFGKCMAGKCAC[1Nal] | 3396 |
| GVIINVKCKISAQCLHPCKDAGMRFGKCMAGKCAC[1Nal]GG-amide | 3397 |
| GVIINVKCKISAQCLKPCKDAGMRFGKCMAGKCAC[4Bip]-amide | 3398 |
| GVIINVKCKISAQCLHPCKDAGMRFGKCMAGKCAC[4Bip]GG-amide | 3399 |
| GVIINVKCKISAQCLKPCKDAGMRFGKCMAGKCHCGGG | 3400 |

TABLE 7F

Addit6ional useful OSK1 peptide analogs: Ala27Substituted Series

| Sequence/structure | SEQ ID NO: |
|---|---|
| GVIINVKCKISRQCLEPCKKAGMRFGACMNGKCHCTPK | 3401 |
| GVIINVSCKISRQCLEPCKKAGMRFGACMNGKCHCTPK | 3402 |
| GVIINVKCKISRQCLKPCKKAGMRFGACMNGKCHCTPK | 3403 |
| GVIINVKCKISRQCLEPCKDAGMRFGACMNGKCHCTPK | 3404 |
| GVIINVKCKISRQCLKPCKDAGMRFGACMNGKCHCTPK | 3405 |
| GVIINVSCKISRQCLKPCKDAGMRFGACMNGKCHCTPK | 3406 |
| GVIINVKCKISPQCLKPCKDAGMRFGACMNGKCHCTPK | 3407 |
| GVIINVKCKISRQCLKPCKDAGMRFGACMNGKCHCYPK | 3408 |
| Ac-GVIINVKCKISPQCLKPCKDAGMRFGACMNGKCHCTPK | 3409 |
| GVIINVKCKISPQCLKPCKDAGMRFGACMNGKCHCTPK-amide | 3410 |
| Ac-GVIINVKCKISPQCLKPCKDAGMRFGACMNGKCHCTPK-amide | 3411 |
| GVIINVKCKISRQCLKPCKDAGMRFGACMNGKCHCYPK-amide | 3412 |
| Ac-GVIINVKCKISRQCLKPCKDAGMRFGACMNGKCHCYPK | 3413 |
| Ac-GVIINVKCKISRQCLKPCKDAGMRFGACMNGKCHCYPK-amide | 3414 |
| GVIINVKCKISRQCLKPCKKAGMRFGACMNGKCHCTPK-amide | 3415 |
| Ac-GVIINVKCKISRQCLKPCKKAGMRFGACMNGKCHCTPK | 3416 |
| Ac-GVIINVKCKISRQCLKPCKKAGMRFGACMNGKCHCTPK-amide | 3417 |
| Ac-GVIINVKCKISRQCLEPCKDAGMRFGACMNGKCHCTPK | 3418 |
| GVIINVKCKISRQCLEPCKDAGMRFGACMNGKCHCTPK-amide | 3419 |
| Ac-GVIINVKCKISRQCLEPCKDAGMRFGACMNGKCHCTPK-amide | 3420 |
| GVIINVKCKISRQCLEPCKKAGMRFGACMNGKCHCTPK-amide | 3421 |

TABLE 7F-continued

Addit6ional useful OSK1 peptide analogs: Ala27Substituted Series

| Sequence/structure | SEQ ID NO: |
|---|---|
| Ac-GVIINVKCKISRQCLEPCKKAGMRFGACMNGKCHCTPK | 3422 |
| Ac-GVIINVKCKISRQCLEPCKKAGMRFGACMNGKCHCTPK-amide | 3423 |
| GVIINVKCKISRQCLKPCKDAGMRFGACMNGKCHCTPK-amide | 3424 |
| Ac-GVIINVKCKISRQCLKPCKDAGMRFGACMNGKCHCTPK | 3425 |
| Ac-GVIINVKCKISRQCLKPCKDAGMRFGACMNGKCHCTPK-amide | 3426 |
| VIINVKCKISRQCLEPCKKAGMRFGACMNGKCHCTPK | 3427 |
| Ac-VIINVKCKISRQCLEPCKKAGMRFGACMNGKCHCTPK | 3428 |
| VIINVKCKISRQCLEPCKKAGMRFGACMNGKCHCTPK-amide | 3429 |
| Ac-VIINVKCKISRQCLEPCKKAGMRFGACMNGKCHCTPK-amide | 3430 |
| GVIINVKCKISRQCLEPCKKAGMRFGACMNGKCACTPK | 3431 |
| Ac-GVIINVKCKISRQCLEPCKKAGMRFGACMNGKCACTPK | 3432 |
| GVIINVKCKISRQCLEPCKKAGMRFGACMNGKCACTPK-amide | 3433 |
| Ac-GVIINVKCKISRQCLEPCKKAGMRFGACMNGKCACTPK-amide | 3434 |
| VIINVKCKISRQCLKPCKDAGMRFGACMNGKCHCTPK | 3435 |
| Ac-VIINVKCKISRQCLKPCKDAGMRFGACMNGKCHCTPK | 3436 |
| VIINVKCKISRQCLKPCKDAGMRFGACMNGKCHCTPK-amide | 3437 |
| Ac-VIINVKCKISRQCLKPCKDAGMRFGACMNGKCHCTPK-amide | 3438 |
| NVKCKISRQCLKPCKDAGMRFGACMNGKCHCTPK | 3439 |
| Ac-NVKCKISRQCLKPCKDAGMRFGACMNGKCHCTPK | 3440 |
| NVKCKISRQCLKPCKDAGMRFGACMNGKCHCTPK-amide | 3441 |
| Ac-NVKCKISRQCLKPCKDAGMRFGACMNGKCHCTPK-amide | 3442 |
| KCKISRQCLKPCKDAGMRFGACMNGKCHCTPK | 3443 |
| Ac-KCKISRQCLKPCKDAGMRFGACMNGKCHCTPK | 3444 |
| KCKISRQCLKPCKDAGMRFGACMNGKCHCTPK-amide | 3445 |
| Ac-KCKISRQCLKPCKDAGMRFGACMNGKCHCTPK-amide | 3446 |
| CKISRQCLKPCKDAGMRFGACMNGKCHCTPK | 3447 |
| Ac-CKISRQCLKPCKDAGMRFGACMNGKCHCTPK | 3448 |
| CKISRQCLKPCKDAGMRFGACMNGKCHCTPK-amide | 3449 |
| Ac-CKISRQCLKPCKDAGMRFGACMNGKCHCTPK-amide | 3450 |
| GVIINVKCKISRQCLKPCKDAGMRNGACMNGKCHCTPK | 3451 |
| GVIINVKCKISRQCLKPCKDAGMRNGACMNGKCHCTPK-amide | 3452 |
| Ac-GVIINVKCKISRQCLKPCKDAGMRNGACMNGKCHCTPK | 3453 |
| Ac-GVIINVKCKISRQCLKPCKDAGMRNGACMNGKCHCTPK-amide | 3454 |

TABLE 7F-continued

Addit6ional useful OSK1 peptide analogs: Ala27Substituted Series

| Sequence/structure | SEQ ID NO: |
|---|---|
| GVIINVKCKISRQCLKPCKDAGMRFGKCMNRKCHCTPK | 3455 |
| GVIINVKCKISRQCLKPCKDAGMRFGKCMNRKCHCTPK-amide | 3456 |
| Ac-GVIINVKCKISRQCLKPCKDAGMRFGKCMNRKCHCTPK | 3457 |
| Ac-GVIINVKCKISRQCLKPCKDAGMRFGKCMNRKCHCTPK-amide | 3458 |
| GVIINVKCKISKQCLKPCRDAGMRFGACMNGKCHCTPK | 3459 |
| Ac-GVIINVKCKISKQCLKPCRDAGMRFGACMNGKCHCTPK | 3460 |
| GVIINVKCKISKQCLKPCRDAGMRFGACMNGKCHCTPK-amide | 3461 |
| Ac-GVIINVKCKISKQCLKPCRDAGMRFGACMNGKCHCTPK-amide | 3462 |
| TIINVKCKISRQCLKPCKDAGMRFGACMNGKCHCTPK | 3463 |
| Ac-TIINVKCKISRQCLKPCKDAGMRFGACMNGKCHCTPK | 3464 |
| TIINVKCKISRQCLKPCKDAGMRFGACMNGKCHCTPK-amide | 3465 |
| Ac-TIINVKCKISRQCLKPCKDAGMRFGACMNGKCHCTPK-amide | 3466 |
| GVKINVKCKISRQCLEPCKKAGMRFGACMNGKCHCTPK | 3467 |
| Ac-GVKINVKCKISRQCLEPCKKAGMRFGACMNGKCHCTPK | 3468 |
| GVKINVKCKISRQCLEPCKKAGMRFGACMNGKCHCTPK-amide | 3469 |
| Ac-GVKINVKCKISRQCLEPCKKAGMRFGACMNGKCHCTPK-amide | 3470 |
| GVKINVKCKISRQCLEPCKKAGMRFGACMNGKCACTPK | 3471 |
| GVKINVKCKISRQCLKPCKDAGMRFGACMNGKCHCTPK | 3472 |
| GVKINVKCKISRQCLKPCKDAGMRFGACMNGKCACTPK | 3473 |
| Ac-GVKINVKCKISRQCLEPCKKAGMRFGACMNGKCACTPK | 3474 |
| GVKINVKCKISRQCLEPCKKAGMRFGACMNGKCACTPK-amide | 3475 |
| Ac-GVKINVKCKISRQCLEPCKKAGMRFGACMNGKCACTPK-amide | 3476 |
| Ac-GVKINVKCKISRQCLKPCKDAGMRFGACMNGKCACTPK | 3477 |
| GVKINVKCKISRQCLKPCKDAGMRFGACMNGKCACTPK-amide | 3478 |
| Ac-GVKINVKCKISRQCLKPCKDAGMRFGACMNGKCACTPK-amide | 3479 |
| Ac-GVKINVKCKISRQCLKPCKDAGMRFGACMNGKCHCTPK | 3480 |
| GVKINVKCKISRQCLKPCKDAGMRFGACMNGKCHCTPK-amide | 3481 |
| Ac-GVKINVKCKISRQCLKPCKDAGMRFGACMNGKCHCTPK-amide | 3482 |
| GVIINVKCKISRQCLKPCKDAGMRFGACMNGKCHCT | 3483 |
| GVIINVKCKISRQCLOPCKDAGMRFGACMNGKCHCTPK | 3484 |
| GVIINVKCKISRQCL[hLys]PCKDAGMRFGACMNGKCHCTPK | 3485 |
| GVIINVKCKISRQCL[hArg]PCKDAGMRFGACMNGKCHCTPK | 3486 |
| GVIINVKCKISRQCL[Cit]PCKDAGMRFGACMNGKCHCTPK | 3487 |

TABLE 7F-continued

Addit6ional useful OSK1 peptide analogs: Ala27Substituted Series

| Sequence/structure | SEQ ID NO: |
|---|---|
| GVIINVKCKISRQCL[hCit]PCKDAGMRFGACMNGKCHCTPK | 3488 |
| GVIINVKCKISRQCL[Dpr]PCKDAGMRFGACMNGKCHCTPK | 3489 |
| GVIINVKCKISRQCL[Dab]PCKDAGMRFGACMNGKCHCTPK | 3490 |
| GVIINVKCKISRQCLOPCKDAGMRFGACMNGKCHCYPK | 3491 |
| GVIINVKCKISRQCL[hLys]PCKDAGMRFGACMNGKCHCYPK | 3492 |
| GVIINVKCKISRQCL[hArg]PCKDAGMRFGACMNGKCHCYPK | 3493 |
| GVIINVKCKISRQCL[Cit]PCKDAGMRFGACMNGKCHCYPK | 3494 |
| GVIINVKCKISRQCL[hCit]PCKDAGMRFGACMNGKCHCYPK | 3495 |
| GVIINVKCKISRQCL[Dpr]PCKDAGMRFGACMNGKCHCYPK | 3496 |
| GVIINVKCKISRQCL[Dab]PCKDAGMRFGACMNGKCHCYPK | 3497 |
| GVIINVKCKISRQCLKPCKDAGMRFGACMNGKCACYPK | 3498 |
| GVIINVKCKISRQCLKPCKDAGMRFGACMNGKCGCYPK | 3499 |
| GVIINVKCKISRQCLKPCKDAGMRFGACMNGKCACFPK | 3500 |
| GVIINVKCKISRQCLKPCKDAGMRFGACMNGKCACWPK | 3501 |
| GVIINVKCKISRQCLKPCKEAGMRFGACMNGKCACYPK | 3502 |
| GVIINVKCKISRQCLOPCKDAGMRFGACMNGKCACTPK | 3503 |
| GVIINVKCKISRQCL[hLys]PCKDAGMRFGACMNGKCACTPK | 3504 |
| GVIINVKCKISRQCL[hArg]PCKDAGMRFGACMNGKCACTPK | 3505 |
| GVIINVKCKISRQCL[Cit]PCKDAGMRFGACMNGKCACTPK | 3506 |
| GVIINVKCKISRQCL[hCit]PCKDAGMRFGACMNGKCHCTPK | 3507 |
| GVIINVKCKISRQCL[Dpr]PCKDAGMRFGACMNGKCACTPK | 3508 |
| GVIINVKCKISRQCL[Dab]PCKDAGMRFGACMNGKCACTPK | 3509 |
| GVIINVKCKISRQCLOPCKDAGMRFGACMNGKCHC | 3510 |
| GVIINVKCKISRQCL[hLys]PCKDAGMRFGACMNGKCHC | 3511 |
| GVIINVKCKISRQCL[hArg]PCKDAGMRFGACMNGKCHC | 3512 |
| GVIINVKCKISRQCL[Cit]PCKDAGMRFGACMNGKCHC | 3513 |
| GVIINVKCKISRQCL[hCit]PCKDAGMRFGACMNGKCHC | 3514 |
| GVIINVKCKISRQCL[Dpr]PCKDAGMRFGACMNGKCHC | 3515 |
| GVIINVKCKISRQCL[Dab]PCKDAGMRFGACMNGKCHC | 3516 |
| GVIINVKCKISRQCLOPCKDAGMRFGACMNGKCAC | 3517 |
| GVIINVKCKISRQCL[hLys]PCKDAGMRFGACMNGKCAC | 3518 |
| GVIINVKCKISRQCL[hArg]PCKDAGMRFGACMNGKCAC | 3519 |
| GVIINVKCKISRQCL[Cit]PCKDAGMRFGACMNGKCAC | 3520 |
| GVIINVKCKISRQCL[hCit]PCKDAGMRFGACMNGKCHC | 3521 |
| GVIINVKCKISRQCL[Dpr]PCKDAGMRFGACMNGKCAC | 3522 |
| GVIINVKCKISRQCL[Dab]PCKDAGMRFGACMNGKCAC | 3523 |

TABLE 7F-continued

Addit6ional useful OSK1 peptide analogs: Ala27Substituted Series

| Sequence/structure | SEQ ID NO: |
|---|---|
| GVIINVKCKISRQCLKPCKDAGMRFGACMNGKCGCYGG | 3524 |
| GVIINVKCKISRQCLOPCKDAGMRFGACMNGKCHCYGG | 3525 |
| GVIINVKCKISRQCL[hLys]PCKDAGMRFGACMNGKCHCYGG | 3526 |
| GVIINVKCKISRQCL[hArg]PCKDAGMRFGACMNGKCHCYGG | 3527 |
| GVIINVKCKISRQCL[Cit]PCKDAGMRFGACMNGKCHCYGG | 3528 |
| GVIINVKCKISRQCL[hCit]PCKDAGMRFGACMNGKCHCYGG | 3529 |
| GVIINVKCKISRQCL[Dpr]PCKDAGMRFGACMNGKCHCYGG | 3530 |
| GVIINVKCKISRQCLKPCKDAGMRFGACMNGKCACYGG | 3531 |
| GVIINVKCKISRQCLOPCKDAGMRFGACMNGKCACYGG | 3532 |
| GVIINVKCKISRQCL[hLys]PCKDAGMRFGACMNGKCACYGG | 3533 |
| GVIINVKCKISRQCL[hArg]PCKDAGMRFGACMNGKCACYGG | 3534 |
| GVIINVKCKISRQCL[Cit]PCKDAGMRFGACMNGKCACYGG | 3535 |
| GVIINVKCKISRQCL[hCit]PCKDAGMRFGACMNGKCHCYGG | 3536 |
| GVIINVKCKISRQCL[Dpr]PCKDAGMRFGACMNGKCACYGG | 3537 |
| GVIINVKCKISRQCL[Dab]PCKDAGMRFGACMNGKCACYGG | 3538 |
| GVIINVKCKISRQCLKPCKDAGMRFGACMNGKCACYG | 3539 |
| GVIINVKCKISRQCLOPCKDAGMRFGACMNGKCHCGGG | 3540 |
| GVIINVKCKISRQCL[hLys]PCKDAGMRFGACMNGKCHCGGG | 3541 |
| GVIINVKCKISRQCL[hArg]PCKDAGMRFGACMNGKCHCGGG | 3542 |
| GVIINVKCKISRQCL[Cit]PCKDAGMRFGACMNGKCHCGGG | 3543 |
| GVIINVKCKISRQCL[hCit]PCKDAGMRFGACMNGKCHCGGG | 3544 |
| GVIINVKCKISRQCL[Dpr]PCKDAGMRFGACMNGKCHCGGG | 3545 |
| GVIINVKCKISRQCLKPCKDAGMRFGACMNGKCACFGG | 3546 |
| GVIINVKCKISRQCLOPCKDAGMRFGACMNGKCACGGG | 3547 |
| GVIINVKCKISRQCL[hLys]PCKDAGMRFGACMNGKCACGGG | 3548 |
| GVIINVKCKISRQCL[hArg]PCKDAGMRFGACMNGKCACGGG | 3549 |
| GVIINVKCKISRQCL[Cit]PCKDAGMRFGACMNGKCACGGG | 3550 |
| GVIINVKCKISRQCL[hCit]PCKDAGMRFGACMNGKCACGGG | 3551 |
| GVIINVKCKISRQCL[Dpr]PCKDAGMRFGACMNGKCACGGG | 3552 |
| GVIINVKCKISRQCL[Dab]PCKDAGMRFGACMNGKCACGGG | 3553 |
| GVIINVKCKISRQCLKPCKDAGMRFGACMNGKCACGG | 3554 |
| GVIINVKCKISRQCLKPCKDAGMRFGACMNGKCACYG | 3555 |
| GVIINVKCKISRQCLOPCKDAGMRFGACMNGKCACGG | 3556 |
| GVIINVKCKISRQCL[hLys]PCKEAGMRFGACMNGKCHCTPK | 3557 |
| GVIINVKCKISRQCL[hArg]PCKEAGMRFGACMNGKCHCTPK | 3558 |
| GVIINVKCKISRQCL[Cit]PCKEAGMRFGACMNGKCHCTPK | 3559 |
| GVIINVKCKISRQCL[hCit]PCKEAGMRFGACMNGKCHCTPK | 3560 |
| GVIINVKCKISRQCL[Dpr]PCKEAGMRFGACMNGKCHCTPK | 3561 |
| GVIINVKCKISRQCL[Dab]PCKEAGMRFGACMNGKCHCTPK | 3562 |
| GVIINVKCKISRQCLOPCKEAGMRFGACMNGKCHCYPK | 3563 |
| GVIINVKCKISRQCL[hLys]PCKEAGMRFGACMNGKCHCYPK | 3564 |
| GVIINVKCKISRQCL[hArg]PCKEAGMRFGACMNGKCHCYPK | 3565 |
| GVIINVKCKISRQCL[Cit]PCKEAGMRFGACMNGKCHCYPK | 3566 |
| GVIINVKCKISRQCL[hCit]PCKEAGMRFGACMNGKCHCYPK | 3567 |
| GVIINVKCKISRQCL[Dpr]PCKEAGMRFGACMNGKCHCYPK | 3568 |
| GVIINVKCKISRQCL[Dab]PCKEAGMRFGACMNGKCHCYPK | 3569 |
| GVIINVKCKISRQCLOPCKEAGMRFGACMNGKCACTPK | 3570 |
| GVIINVKCKISRQCL[hLys]PCKEAGMRFGACMNGKCACTPK | 3571 |
| GVIINVKCKISRQCL[hArg]PCKEAGMRFGACMNGKCACTPK | 3572 |
| GVIINVKCKISRQCL[Cit]PCKEAGMRFGACMNGKCACTPK | 3573 |
| GVIINVKCKISRQCL[hCit]PCKEAGMRFGACMNGKCHCTPK | 3574 |
| GVIINVKCKISRQCL[Dpr]PCKEAGMRFGACMNGKCACTPK | 3575 |
| GVIINVKCKISRQCL[Dab]PCKEAGMRFGACMNGKCACTPK | 3576 |
| GVIINVKCKISRQCLOPCKEAGMRFGACMNGKCHC | 3577 |
| GVIINVKCKISRQCL[hLys]PCKEAGMRFGACMNGKCHC | 3578 |
| GVIINVKCKISRQCL[hArg]PCKEAGMRFGACMNGKCHC | 3579 |
| GVIINVKCKISRQCL[Cit]PCKEAGMRFGACMNGKCHC | 3580 |
| GVIINVKCKISRQCL[hCit]PCKEAGMRFGACMNGKCHC | 3581 |
| GVIINVKCKISRQCL[Dpr]PCKEAGMRFGACMNGKCHC | 3582 |
| GVIINVKCKISRQCLOPCKEAGMRFGACMNGKCAC | 3583 |
| GVIINVKCKISRQCL[hLys]PCKEAGMRFGACMNGKCAC | 3584 |
| GVIINVKCKISRQCL[hArg]PCKEAGMRFGACMNGKCAC | 3585 |
| GVIINVKCKISRQCL[Cit]PCKEAGMRFGACMNGKCAC | 3586 |
| GVIINVKCKISRQCL[hCit]PCKEAGMRFGACMNGKCHC | 3587 |
| GVIINVKCKISRQCL[Dpr]PCKEAGMRFGACMNGKCAC | 3588 |
| GVIINVKCKISRQCL[Dab]PCKEAGMRFGACMNGKCAC | 3589 |
| GVIINVKCKISRQCLKPCKEAGMRFGACMNGKCHCYGG | 3590 |
| GVIINVKCKISRQCLOPCKEAGMRFGACMNGKCHCYGG | 3591 |
| GVIINVKCKISRQCLKPCKEAGMRFGACMNGKCHCYG | 3592 |
| GVIINVKCKISRQCLKPCKEAGMRFGACMNGKCACYG | 3593 |
| GVIINVKCKISRQCL[hLys]PCKEAGMRFGACMNGKCHCYGG | 3594 |
| GVIINVKCKISRQCL[hArg]PCKEAGMRFGACMNGKCHCYGG | 3595 |

TABLE 7F-continued

Addit6ional useful OSK1 peptide analogs: Ala27Substituted Series

| Sequence/structure | SEQ ID NO: |
|---|---|
| GVIINVKCKISRQCL[Cit]PCKEAGMRFGACMNGKCHCYGG | 3596 |
| GVIINVKCKISRQCL[hCit]PCKEAGMRFGACMNGKCHCYGG | 3597 |
| GVIINVKCKISRQCL[Dpr]PCKEAGMRFGACMNGKCHCYGG | 3598 |
| GVIINVKCKISRQCL[Dab]PCKEAGMRFGACMNGKCHCYGG | 3599 |
| GVIINVKCKISRQCLKPCKEAGMRFGACMNGKCACYG | 3600 |
| GVIINVKCKISRQCLOPCKEAGMRFGACMNGKCACYGG | 3601 |
| GVIINVKCKISRQCL[hLys]PCKEAGMRFGACMNGKCACYGG | 3602 |
| GVIINVKCKISRQCL[hArg]PCKEAGMRFGACMNGKCACYGG | 3603 |
| GVIINVKCKISRQCL[Cit]PCKEAGMRFGACMNGKCACYGG | 3604 |
| GVIINVKCKISRQCL[hCit]PCKEAGMRFGACMNGKCHCYGG | 3605 |
| GVIINVKCKISRQCL[Dpr]PCKEAGMRFGACMNGKCACYGG | 3606 |
| GVIINVKCKISRQCL[Dab]PCKEAGMRFGACMNGKCACYGG | 3607 |
| GVIINVKCKISRQCLKPCKEAGMRFGACMNGKCACFGG | 3608 |
| GVIINVKCKISRQCLOPCKEAGMRFGACMNGKCHCGGG | 3609 |
| GVIINVKCKISRQCL[hLys]PCKEAGMRFGACMNGKCHCGGG | 3610 |
| GVIINVKCKISRQCL[hArg]PCKEAGMRFGACMNGKCHCGGG | 3611 |
| GVIINVKCKISRQCL[Cit]PCKEAGMRFGACMNGKCHCGGG | 3612 |
| GVIINVKCKISRQCL[hCit]PCKEAGMRFGACMNGKCHCGGG | 3613 |
| GVIINVKCKISRQCL[Dpr]PCKEAGMRFGACMNGKCHCGGG | 3614 |
| GVIINVKCKISRQCLOPCKEAGMRFGACMNGKCACGGG | 3615 |
| GVIINVKCKISRQCL[hLys]PCKEAGMRFGACMNGKCACGGG | 3616 |
| GVIINVKCKISRQCL[hArg]PCKEAGMRFGACMNGKCACGGG | 3617 |
| GVIINVKCKISRQCL[Cit]PCKEAGMRFGACMNGKCACGGG | 3618 |
| GVIINVKCKISRQCL[hCit]PCKEAGMRFGACMNGKCACTP | 3619 |
| GVIINVKCKISRQCL[Dpr]PCKEAGMRFGACMNGKCACTP | 3620 |
| GVIINVKCKISRQCL[Dab]PCKEAGMRFGACMNGKCACTP | 3621 |
| GVIINVKCKISRQCLOPCKDAGMRFGACMNGKCHCTPK-amide | 3622 |
| GVIINVKCKISRQCL[hLys]PCKDAGMRFGACMNGKCHCTPK-amide | 3623 |
| GVIINVKCKISRQCL[hArg]PCKDAGMRFGACMNGKCHCTPK-amide | 3624 |
| GVIINVKCKISRQCL[Cit]PCKDAGMRFGACMNGKCHCTPK-amide | 3625 |
| GVIINVKCKISRQCL[hCit]PCKDAGMRFGACMNGKCHCTPK-amide | 3626 |
| GVIINVKCKISRQCL[Dpr]PCKDAGMRFGACMNGKCHCTPK-amide | 3627 |
| GVIINVKCKISRQCL[Dab]PCKDAGMRFGACMNGKCHCTPK-amide | 3628 |

TABLE 7F-continued

Addit6ional useful OSK1 peptide analogs: Ala27Substituted Series

| Sequence/structure | SEQ ID NO: |
|---|---|
| GVIINVKCKISRQCLOPCKDAGMRFGACMNGKCHCYPK-amide | 3629 |
| GVIINVKCKISRQCL[hLys]PCKDAGMRFGACMNGKCHCYPK-amide | 3630 |
| GVIINVKCKISRQCL[hArg]PCKDAGMRFGACMNGKCHCYPK-amide | 3631 |
| GVIINVKCKISRQCL[Cit]PCKDAGMRFGACMNGKCHCYPK-amide | 3632 |
| GVIINVKCKISRQCL[hCit]PCKDAGMRFGACMNGKCHCYPK-amide | 3633 |
| GVIINVKCKISRQCL[Dpr]PCKDAGMRFGACMNGKCHCYPK-amide | 3634 |
| GVIINVKCKISRQCL[Dab]PCKDAGMRFGACMNGKCHCYPK-amide | 3635 |
| GVIINVKCKISRQCLOPCKDAGMRFGACMNGKCACTPK-amide | 3636 |
| GVIINVKCKISRQCL[hLys]PCKDAGMRFGACMNGKCACTPK-amide | 3637 |
| GVIINVKCKISRQCL[hArg]PCKDAGMRFGACMNGKCACTPK-amide | 3638 |
| GVIINVKCKISRQCL[Cit]PCKDAGMRFGACMNGKCACTPK-amide | 3639 |
| GVIINVKCKISRQCL[hCit]PCKDAGMRFGACMNGKCACTPK-amide | 3640 |
| GVIINVKCKISRQCL[Dpr]PCKDAGMRFGACMNGKCACTPK-amide | 3641 |
| GVIINVKCKISRQCL[Dab]PCKDAGMRFGACMNGKCACTPK-amide | 3642 |
| GVIINVKCKISRQCLOPCKDAGMRFGACMNGKCHC-amide | 3643 |
| GVIINVKCKISRQCL[hLys]PCKDAGMRFGACMNGKCHC-amide | 3644 |
| GVIINVKCKISRQCL[hArg]PCKDAGsMRFGACMNGKCHC-amide | 3645 |
| GVIINVKCKISRQCL[Cit]PCKDAGMRFGACMNGKCHC-amide | 3646 |
| GVIINVKCKISRQCL[hCit]PCKDAGMRFGACMNGKCHC-amide | 3647 |
| GVIINVKCKISRQCL[Dpr]PCKDAGMRFGACMNGKCHC-amide | 3648 |
| GVIINVKCKISRQCLOPCKDAGMRFGACMNGKCAC-amide | 3649 |
| GVIINVKCKISRQCL[hLys]PCKDAGMRFGACMNGKCAC-amide | 3650 |
| GVIINVKCKISRQCL[hArg]PCKDAGMRFGACMNGKCAC-amide | 3651 |
| GVIINVKCKISRQCL[Cit]PCKDAGMRFGACMNGKCAC-amide | 3652 |
| GVIINVKCKISRQCL[hCit]PCKDAGMRFGACMNGKCHC-amide | 3653 |
| GVIINVKCKISRQCL[Dpr]PCKDAGMRFGACMNGKCAC-amide | 3654 |
| GVIINVKCKISRQCL[Dab]PCKDAGMRFGACMNGKCAC-amide | 3655 |

TABLE 7F-continued

| Addit6ional useful OSK1 peptide analogs: Ala27Substituted Series | |
|---|---|
| Sequence/structure | SEQ ID NO: |
| GVIINVKCKISRQCLKPCKDAGMRFGACMNGKCHCYGG-amide | 3656 |
| GVIINVKCKISRQCLOPCKDAGMRFGACMNGKCHCYGG-amide | 3657 |
| GVIINVKCKISRQCL[hLys]PCKDAGMRFGACMNGKCHCYGG-amide | 3658 |
| GVIINVKCKISRQCL[hArg]PCKDAGMRFGACMNGKCHCYGG-amide | 3659 |
| GVIINVKCKISRQCL[Cit]PCKDAGMRFGACMNGKCHCYGG-amide | 3660 |
| GVIINVKCKISRQCL[hCit]PCKDAGMRFGACMNGKCHCYGG-amide | 3661 |
| GVIINVKCKISRQCL[Dpr]PCKDAGMRFGACMNGKCHCYGG-amide | 3662 |
| GVIINVKCKISRQCLKPCKDAGMRFGACMNGKCHCFGG-amide | 3663 |
| GVIINVKCKISRQCLKPCKDAGMRFGACMNGKCHCYG-amide | 3664 |
| GVIINVKCKISRQCLKPCKDAGMRFGACMNGKCACYG-amide | 3665 |
| GVIINVKCKISRQCLOPCKDAGMRFGACMNGKCACYGG-amide | 3666 |
| GVIINVKCKISRQCL[hLys]PCKDAGMRFGACMNGKCACYGG-amide | 3667 |
| GVIINVKCKISRQCL[hArg]PCKDAGMRFGACMNGKCACYGG-amide | 3668 |
| GVIINVKCKISRQCL[Cit]PCKDAGMRFGACMNGKCACYGG-amide | 3669 |
| GVIINVKCKISRQCL[hCit]PCKDAGMRFGACMNGKCACYGG-amide | 3670 |
| GVIINVKCKISRQCL[Dpr]PCKDAGMRFGACMNGKCACYGG-amide | 3671 |
| GVIINVKCKISRQCL[Dab]PCKDAGMRFGACMNGKCACYGG-amide | 3672 |
| GVIINVKCKISRQCLKPCKDAGMRFGACMNGKCACYGG-amide | 3673 |
| GVIINVKCKISRQCLOPCKDAGMRFGACMNGKCHCGGG-amide | 3674 |
| GVIINVKCKISRQCL[hLys]PCKDAGMRFGACMNGKCHCGGG-amide | 3675 |
| GVIINVKCKISRQCL[hArg]PCKDAGMRFGACMNGKCHCGGG-amide | 3676 |
| GVIINVKCKISRQCL[Cit]PCKDAGMRFGACMNGKCHCGGG-amide | 3677 |
| GVIINVKCKISRQCL[hCit]PCKDAGMRFGACMNGKCHCGGG-amide | 3678 |
| GVIINVKCKISRQCL[Dpr]PCKDAGMRFGACMNGKCHCGGG-amide | 3679 |
| GVIINVKCKISRQCLKPCKDAGMRFGACMNGKCACGGG-amide | 3680 |
| GVIINVKCKISRQCLOPCKDAGMRFGACMNGKCACFGG-amide | 3681 |
| GVIINVKCKISRQCLOPCKDAGMRFGACMNGKCACGGG-amide | 3682 |

TABLE 7F-continued

| Addit6ional useful OSK1 peptide analogs: Ala27Substituted Series | |
|---|---|
| Sequence/structure | SEQ ID NO: |
| GVIINVKCKISRQCL[hLys]PCKDAGMRFGACMNGKCACGGG-amide | 3683 |
| GVIINVKCKISRQCL[hArg]PCKDAGMRFGACMNGKCACGGG-amide | 3684 |
| GVIINVKCKISRQCL[Cit]PCKDAGMRFGACMNGKCACGGG-amide | 3685 |
| GVIINVKCKISRQCL[hCit]PCKDAGMRFGACMNGKCACGGG-amide | 3686 |
| GVIINVKCKISRQCL[Dpr]PCKDAGMRFGACMNGKCACGGG-amide | 3687 |
| GVIINVKCKISRQCL[Dab]PCKDAGMRFGACMNGKCACGGG-amide | 3688 |
| GVIINVKCKISRQCLOPCKEAGMRFGACMNGKCHCTPK-amide | 3689 |
| GVIINVKCKISRQCL[hLys]PCKEAGMRFGACMNGKCHCTPK-amide | 3690 |
| GVIINVKCKISRQCL[hArg]PCKEAGMRFGACMNGKCHCTPK-amide | 3691 |
| GVIINVKCKISRQCL[Cit]PCKEAGMRFGACMNGKCHCTPK-amide | 3692 |
| GVIINVKCKISRQCL[hCit]PCKEAGMRFGACMNGKCHCTPK-amide | 3693 |
| GVIINVKCKISRQCL[Dpr]PCKEAGMRFGACMNGKCHCTPK-amide | 3694 |
| GVIINVKCKISRQCL[Dab]PCKEAGMRFGACMNGKCHCTPK-amide | 3695 |
| GVIINVKCKISRQCLOPCKEAGMRFGACMNGKCHCYPK-amide | 3696 |
| GVIINVKCKISRQCL[hLys]PCKEAGMRFGACMNGKCHCYPK-amide | 3697 |
| GVIINVKCKISRQCL[hArg]PCKEAGMRFGACMNGKCHCYPK-amide | 3698 |
| GVIINVKCKISRQCL[Cit]PCKEAGMRFGACMNGKCHCYPK-amide | 3699 |
| GVIINVKCKISRQCL[hCit]PCKEAGMRFGACMNGKCHCYPK-amide | 3700 |
| GVIINVKCKISRQCL[Dpr]PCKEAGMRFGACMNGKCHCYPK-amide | 3701 |
| GVIINVKCKISRQCL[Dab]PCKEAGMRFGACMNGKCHCYPK-amide | 3702 |
| GVIINVKCKISRQCLOPCKEAGMRFGACMNGKCACTPK-amide | 3703 |
| GVIINVKCKISRQCL[hLys]PCKEAGMRFGACMNGKCACTPK-amide | 3704 |
| GVIINVKCKISRQCL[hArg]PCKEAGMRFGACMNGKCACTPK-amide | 3705 |
| GVIINVKCKISRQCL[Cit]PCKEAGMRFGACMNGKCACTPK-amide | 3706 |
| GVIINVKCKISRQCL[hCit]PCKEAGMRFGACMNGKCACTPK-amide | 3707 |

TABLE 7F-continued

Addit6ional useful OSK1 peptide analogs: Ala27Substituted Series

| Sequence/structure | SEQ ID NO: |
|---|---|
| GVIINVKCKISRQCL[Dpr]PCKEAGMRFGACMNGKCACTPK-amide | 3708 |
| GVIINVKCKISRQCL[Dab]PCKEAGMRFGACMNGKCACTPK-amide | 3709 |
| GVIINVKCKISRQCLOPCKEAGMRFGACMNGKCHC-amide | 3710 |
| GVIINVKCKISRQCL[hLys]PCKEAGMRFGACMNGKCHC-amide | 3711 |
| GVIINVKCKISRQCL[hArg]PCKEAGMRFGACMNGKCHC-amide | 3712 |
| GVIINVKCKISRQCL[Cit]PCKEAGMRFGACMNGKCHC-amide | 3713 |
| GVIINVKCKISRQCL[hCit]PCKEAGMRFGACMNGKCHC-amide | 3714 |
| GVIINVKCKISRQCL[Dpr]PCKEAGMRFGACMNGKCHC-amide | 3715 |
| GVIINVKCKISRQCLOPCKEAGMRFGACMNGKCAC-amide | 3716 |
| GVIINVKCKISRQCL[hLys]PCKEAGMRFGACMNGKCAC-amide | 3717 |
| GVIINVKCKISRQCL[hArg]PCKEAGMRFGACMNGKCAC-amide | 3718 |
| GVIINVKCKISRQCL[Cit]PCKEAGMRFGACMNGKCAC-amide | 3719 |
| GVIINVKCKISRQCL[hCit]PCKEAGMRFGACMNGKCHC-amide | 3720 |
| GVIINVKCKISRQCL[Dpr]PCKEAGMRFGACMNGKCAC-amide | 3721 |
| GVIINVKCKISRQCL[Dab]PCKEAGMRFGACMNGKCAC-amide | 3722 |
| GVIINVKCKISRQCLKPCKEAGMRFGACMNGKCHCWGG-amide | 3723 |
| GVIINVKCKISRQCLOPCKEAGMRFGACMNGKCHCYGG-amide | 3724 |
| GVIINVKCKISRQCL[hLys]PCKEAGMRFGACMNGKCHCYGG-amide | 3725 |
| GVIINVKCKISRQCL[hArg]PCKEAGMRFGACMNGKCHCYGG-amide | 3726 |
| GVIINVKCKISRQCL[Cit]PCKEAGMRFGACMNGKCHCYGG-amide | 3727 |
| GVIINVKCKISRQCL[hCit]PCKEAGMRFGACMNGKCHCYGG-amide | 3728 |
| GVIINVKCKISRQCL[Dpr]PCKEAGMRFGACMNGKCHCYGG-amide | 3729 |
| GVIINVKCKISRQCL[Dab]PCKEAGMRFGACMNGKCHCYGG-amide | 3730 |
| GVIINVKCKISRQCLKPCKEAGMRFGACMNGKCACYGG-amide | 3731 |
| GVIINVKCKISRQCLOPCKEAGMRFGACMNGKCACYGG-amide | 3732 |
| GVIINVKCKISRQCL[hLys]PCKEAGMRFGACMNGKCACYGG-amide | 3733 |
| GVIINVKCKISRQCL[hArg]PCKEAGMRFGACMNGKCACYGG-amide | 3734 |
| GVIINVKCKISRQCL[Cit]PCKEAGMRFGACMNGKCACYGG-amide | 3735 |

TABLE 7F-continued

Addit6ional useful OSK1 peptide analogs: Ala27Substituted Series

| Sequence/structure | SEQ ID NO: |
|---|---|
| GVIINVKCKISRQCL[hCit]PCKEAGMRFGACMNGKCHCYGG-amide | 3736 |
| GVIINVKCKISRQCL[Dpr]PCKEAGMRFGACMNGKCACYGG-amide | 3737 |
| GVIINVKCKISRQCL[Dab]PCKEAGMRFGACMNGKCACYGG-amide | 3738 |
| GVIINVKCKISRQCLOPCKEAGMRFGACMNGKCHCGGG-amide | 3739 |
| GVIINVKCKISRQCL[hLys]PCKEAGMRFGACMNGKCHCGGG-amide | 3740 |
| GVIINVKCKISRQCL[hArg]PCKEAGMRFGACMNGKCHCGGG-amide | 3741 |
| GVIINVKCKISRQCL[Cit]PCKEAGMRFGACMNGKCHCGGG-amide | 3742 |
| GVIINVKCKISRQCL[hCit]PCKEAGMRFGACMNGKCHCGGG-amide | 3743 |
| GVIINVKCKISRQCL[Dpr]PCKEAGMRFGACMNGKCHCGGG-amide | 3744 |
| GVIINVKCKISRQCLOPCKEAGMRFGACMNGKCACGGG-amide | 3745 |
| GVIINVKCKISRQCL[hLys]PCKEAGMRFGACMNGKCACGGG-amide | 3746 |
| GVIINVKCKISRQCL[hArg]PCKEAGMRFGACMNGKCACGGG-amide | 3747 |
| GVIINVKCKISRQCL[Cit]PCKEAGMRFGACMNGKCACGGG-amide | 3748 |
| GVIINVKCKISRQCL[hCit]PCKEAGMRFGACMNGKCACTP-amide | 3749 |
| GVIINVKCKISRQCL[Dpr]PCKEAGMRFGACMNGKCACGGG-amide | 3750 |
| GVIINVKCKISRQCL[Dab]PCKEAGMRFGACMNGKCACGGG-amide | 3751 |
| GVIINVKCKISRQCLKPCK[Cpa]AGMRFGACMNGKCACYGG-amide | 3752 |
| GVIINVKCKISRQCLKPCK[Cpa]AGMRFGACMNGKCACGGG-amide | 3753 |
| GVIINVKCKISRQCLKPCK[Cpa]AGMRFGACMNGKCACY-amide | 3754 |
| Ac-GVIINVKCKISRQCLKPCKDAGMRFGACMNGKCACYGG-amide | 3755 |
| GVIINVKCKISRQCLKPCK[Aad]AGMRFGACMNGKCACYGG-amide | 3756 |
| GVIINVKCKISRQCLKPCK[Aad]AGMRFGACMNGKCHCYGG-amide | 3757 |
| GVIINVKCKISRQCLKPCK[Aad]AGMRFGACMNGKCACYGG | 3758 |
| GVIINVKCKISRQCLHPCKDAGMRFGACMNGKCACYGG-amide | 3759 |
| GVIINVKCKISRQCLHPCKDAGMRFGACMNGKCACYGG | 3760 |
| GVIINVKCKISRQCLHPCKDAGMRFGACMNGKCACY-amide | 3761 |

TABLE 7F-continued

Addit6ional useful OSK1 peptide analogs: Ala27Substituted Series

| Sequence/structure | SEQ ID NO: |
|---|---|
| GVIINVKCKISRQCLHPCKDAGMRFGACMNGKCHCYGG-amide | 3762 |
| GVIINVKCKISRQCLHPCKDAGMRFGACMNGKCHCYGG | 3763 |
| GVIINVKCKISRQCLHPCKDAGMRFGACMNGKCHCYPK | 3764 |
| GVIINVKCKISRQCLHPCKDAGMRFGACMNGKCAC | 3765 |
| GVIINVKCKISRQCLKPCKDAGMRFGACMNGKCAC[1Nal]GG-amide | 3766 |
| GVIINVKCKISRQCLKPCKDAGMRFGACMNGKCAC[1Nal]PK-amide | 3767 |
| GVIINVKCKISRQCLKPCKDAGMRFGACMNGKCAC[2Nal]GG-amide | 3768 |
| GVIINVKCKISRQCLKPCKDAGMRFGACMNGKCAC[Cha]GG-amide | 3769 |
| GVIINVKCKISRQCLKPCKDAGMRFGACMNGKCAC[MePhe]GG-amide | 3770 |
| GVIINVKCKISRQCLKPCKDAGMRFGACMNGKCAC[BiPhA]GG-amide | 3771 |
| GVIINVKCKISRQCLKPCKDAGMRFGACMNGKC[Aib]CYGG-amide | 3772 |
| GVIINVKCKISRQCLKPCKDAGMRFGACMNGKC[Abu]CYGG-amide | 3773 |
| GVIINVKCKISRQCLKPCKDAGMRFGACMNGKCAC[1Nal] | 3774 |
| GVIINVKCKISRQCLHPCKDAGMRFGACMNGKCAC[1Nal]GG-amide | 3775 |
| GVIINVKCKISRQCLKPCKDAGMRFGACMNGKCAC[4Bip]-amide | 3776 |
| GVIINVKCKISRQCLHPCKDAGMRFGACMNGKCAC[4Bip]GG-amide | 3777 |
| GVIINVKCKISRQCLKPCKDAGMRFGACMNGKCHCGGG | 3778 |

TABLE 7G

Additional useful OSK1 peptide analogs: Ala 29 Substituted Series

| Sequence/structure | SEQ ID NO: |
|---|---|
| GVIINVKCKISRQCLEPCKKAGMRFGKCANGKCHCTPK | 3779 |
| GVIINVSCKISRQCLEPCKKAGMRFGKCANGKCHCTPK | 3780 |
| GVIINVKCKISRQCLKPCKKAGMRFGKCANGKCHCTPK | 3781 |
| GVIINVKCKISRQCLEPCKDAGMRFGKCANGKCHCTPK | 3782 |
| GVIINVKCKISRQCLKPCKDAGMRFGKCANGKCHCTPK | 3783 |
| GVIINVSCKISRQCLKPCKDAGMRFGKCANGKCHCTPK | 3784 |
| GVIINVKCKISPQCLKPCKDAGMRFGKCANGKCHCTPK | 3785 |

TABLE 7G-continued

Additional useful OSK1 peptide analogs: Ala 29 Substituted Series

| Sequence/structure | SEQ ID NO: |
|---|---|
| GVIINVKCKISRQCLKPCKDAGMRFGKCANGKCHCYPK | 3786 |
| Ac-GVIINVKCKISPQCLKPCKDAGMRFGKCANGKCHCTPK | 3787 |
| GVIINVKCKISPQCLKPCKDAGMRFGKCANGKCHCTPK-amide | 3788 |
| Ac-GVIINVKCKISPQCLKPCKDAGMRFGKCANGKCHCTPK-amide | 3789 |
| GVIINVKCKISRQCLKPCKDAGMRFGKCANGKCHCYPK-amide | 3790 |
| Ac-GVIINVKCKISRQCLKPCKDAGMRFGKCANGKCHCYPK | 3791 |
| Ac-GVIINVKCKISRQCLKPCKDAGMRFGKCANGKCHCYPK-amide | 3792 |
| GVIINVKCKISRQCLKPCKKAGMRFGKCANGKCHCTPK-amide | 3793 |
| Ac-GVIINVKCKISRQCLKPCKKAGMRFGKCANGKCHCTPK | 3794 |
| Ac-GVIINVKCKISRQCLKPCKKAGMRFGKCANGKCHCTPK-amide | 3795 |
| Ac-GVIINVKCKISRQCLEPCKDAGMRFGKCANGKCHCTPK | 3796 |
| GVIINVKCKISRQCLEPCKDAGMRFGKCANGKCHCTPK-amide | 3797 |
| Ac-GVIINVKCKISRQCLEPCKDAGMRFGKCANGKCHCTPK-amide | 3798 |
| GVIINVKCKISRQCLEPCKKAGMRFGKCANGKCHCTPK-amide | 3799 |
| Ac-GVIINVKCKISRQCLEPCKKAGMRFGKCANGKCHCTPK | 3800 |
| Ac-GVIINVKCKISRQCLEPCKKAGMRFGKCANGKCHCTPK-amide | 3801 |
| GVIINVKCKISRQCLKPCKDAGMRFGKCANGKCHCTPK-amide | 3802 |
| Ac-GVIINVKCKISRQCLKPCKDAGMRFGKCANGKCHCTPK | 3803 |
| Ac-GVIINVKCKISRQCLKPCKDAGMRFGKCANGKCHCTPK-amide | 3804 |
| VIINVKCKISRQCLEPCKKAGMRFGKCANGKCHCTPK | 3805 |
| Ac-VIINVKCKISRQCLEPCKKAGMRFGKCANGKCHCTPK | 3806 |
| VIINVKCKISRQCLEPCKKAGMRFGKCANGKCHCTPK-amide | 3807 |
| Ac-VIINVKCKISRQCLEPCKKAGMRFGKCANGKCHCTPK-amide | 3808 |
| GVIINVKCKISRQCLEPCKKAGMRFGKCANGKCACTPK | 3809 |
| Ac-GVIINVKCKISRQCLEPCKKAGMRFGKCANGKCACTPK | 3810 |
| GVIINVKCKISRQCLEPCKKAGMRFGKCANGKCACTPK-amide | 3811 |
| Ac-GVIINVKCKISRQCLEPCKKAGMRFGKCANGKCACTPK-amide | 3812 |
| VIINVKCKISRQCLKPCKDAGMRFGKCANGKCHCTPK | 3813 |
| Ac-VIINVKCKISRQCLKPCKDAGMRFGKCANGKCHCTPK | 3814 |
| VIINVKCKISRQCLKPCKDAGMRFGKCANGKCHCTPK-amide | 3815 |
| Ac-VIINVKCKISRQCLKPCKDAGMRFGKCANGKCHCTPK-amide | 3816 |

TABLE 7G-continued

Additional useful OSK1 peptide analogs: Ala 29 Substituted Series

| Sequence/structure | SEQ ID NO: |
|---|---|
| NVKCKISRQCLKPCKDAGMRFGKCANGKCHCTPK | 3817 |
| Ac-NVKCKISRQCLKPCKDAGMRFGKCANGKCHCTPK | 3818 |
| NVKCKISRQCLKPCKDAGMRFGKCANGKCHCTPK-amide | 3819 |
| Ac-NVKCKISRQCLKPCKDAGMRFGKCANGKCHCTPK-amide | 3820 |
| KCKISRQCLKPCKDAGMRFGKCANGKCHCTPK | 3821 |
| Ac-KCKISRQCLKPCKDAGMRFGKCANGKCHCTPK | 3822 |
| KCKISRQCLKPCKDAGMRFGKCANGKCHCTPK-amide | 3823 |
| Ac-KCKISRQCLKPCKDAGMRFGKCANGKCHCTPK-amide | 3824 |
| CKISRQCLKPCKDAGMRFGKCANGKCHCTPK | 3825 |
| Ac-CKISRQCLKPCKDAGMRFGKCANGKCHCTPK | 3826 |
| CKISRQCLKPCKDAGMRFGKCANGKCHCTPK-amide | 3827 |
| Ac-CKISRQCLKPCKDAGMRFGKCANGKCHCTPK-amide | 3828 |
| GVIINVKCKISRQCLKPCKDAGMRNGKCANGKCHCTPK | 3829 |
| GVIINVKCKISRQCLKPCKDAGMRNGKCANGKCHCTPK-amide | 3830 |
| Ac-GVIINVKCKISRQCLKPCKDAGMRNGKCANGKCHCTPK | 3831 |
| Ac-GVIINVKCKISRQCLKPCKDAGMRNGKCANGKCHCTPK-amide | 3832 |
| GVIINVKCKISRQCLKPCKDAGMRFGKCMNRKCHCTPK | 3833 |
| GVIINVKCKISRQCLKPCKDAGMRFGKCMNRKCHCTPK-amide | 3834 |
| Ac-GVIINVKCKISRQCLKPCKDAGMRFGKCMNRKCHCTPK | 3835 |
| Ac-GVIINVKCKISRQCLKPCKDAGMRFGKCMNRKCHCTPK-amide | 3836 |
| GVIINVKCKISKQCLKPCRDAGMRFGKCANGKCHCTPK | 3837 |
| Ac-GVIINVKCKISKQCLKPCRDAGMRFGKCANGKCHCTPK | 3838 |
| GVIINVKCKISKQCLKPCRDAGMRFGKCANGKCHCTPK-amide | 3839 |
| Ac-GVIINVKCKISKQCLKPCRDAGMRFGKCANGKCHCTPK-amide | 3840 |
| TIINVKCKISRQCLKPCKDAGMRFGKCANGKCHCTPK | 3841 |
| Ac-TIINVKCKISRQCLKPCKDAGMRFGKCANGKCHCTPK | 3842 |
| TIINVKCKISRQCLKPCKDAGMRFGKCANGKCHCTPK-amide | 3843 |
| Ac-TIINVKCKISRQCLKPCKDAGMRFGKCANGKCHCTPK-amide | 3844 |
| GVKINVKCKISRQCLEPCKKAGMRFGKCANGKCHCTPK | 3845 |
| Ac-GVKINVKCKISRQCLEPCKKAGMRFGKCANGKCHCTPK | 3846 |
| GVKINVKCKISRQCLEPCKKAGMRFGKCANGKCHCTPK-amide | 3847 |
| Ac-GVKINVKCKISRQCLEPCKKAGMRFGKCANGKCHCTPK-amide | 3848 |
| GVKINVKCKISRQCLEPCKKAGMRFGKCANGKCACTPK | 3849 |
| GVKINVKCKISRQCLKPCKDAGMRFGKCANGKCHCTPK | 3850 |

TABLE 7G-continued

Additional useful OSK1 peptide analogs: Ala 29 Substituted Series

| Sequence/structure | SEQ ID NO: |
|---|---|
| GVKINVKCKISRQCLKPCKDAGMRFGKCANGKCACTPK | 3851 |
| Ac-GVKINVKCKISRQCLEPCKKAGMRFGKCANGKCACTPK | 3852 |
| GVKINVKCKISRQCLEPCKKAGMRFGKCANGKCACTPK-amide | 3853 |
| Ac-GVKINVKCKISRQCLEPCKKAGMRFGKCANGKCACTPK-amide | 3854 |
| Ac-GVKINVKCKISRQCLKPCKDAGMRFGKCANGKCACTPK | 3855 |
| GVKINVKCKISRQCLKPCKDAGMRFGKCANGKCACTPK-amide | 3856 |
| Ac-GVKINVKCKISRQCLKPCKDAGMRFGKCANGKCACTPK-amide | 3857 |
| Ac-GVKINVKCKISRQCLKPCKDAGMRFGKCANGKCHCTPK | 3858 |
| GVKINVKCKISRQCLKPCKDAGMRFGKCANGKCHCTPK-amide | 3859 |
| Ac-GVKINVKCKISRQCLKPCKDAGMRFGKCANGKCHCTPK-amide | 3860 |
| GVIINVKCKISRQCLKPCKDAGMRFGKCANGKCHCT | 3861 |
| GVIINVKCKISRQCLOPCKDAGMRFGKCANGKCHCTPK | 3862 |
| GVIINVKCKISRQCL[hLys]PCKDAGMRFGKCANGKCHCTPK | 3863 |
| GVIINVKCKISRQCL[hArg]PCKDAGMRFGKCANGKCHCTPK | 3864 |
| GVIINVKCKISRQCL[Cit]PCKDAGMRFGKCANGKCHCTPK | 3865 |
| GVIINVKCKISRQCL[hCit]PCKDAGMRFGKCANGKCHCTPK | 3866 |
| GVIINVKCKISRQCL[Dpr]PCKDAGMRFGKCANGKCHCTPK | 3867 |
| GVIINVKCKISRQCL[Dab]PCKDAGMRFGKCANGKCHCTPK | 3868 |
| GVIINVKCKISRQCLOPCKDAGMRFGKCANGKCHCYPK | 3869 |
| GVIINVKCKISRQCL[hLys]PCKDAGMRFGKCANGKCHCYPK | 3870 |
| GVIINVKCKISRQCL[hArg]PCKDAGMRFGKCANGKCHCYPK | 3871 |
| GVIINVKCKISRQCL[Cit]PCKDAGMRFGKCANGKCHCYPK | 3872 |
| GVIINVKCKISRQCL[hCit]PCKDAGMRFGKCANGKCHCYPK | 3873 |
| GVIINVKCKISRQCL[Dpr]PCKDAGMRFGKCANGKCHCYPK | 3874 |
| GVIINVKCKISRQCL[Dab]PCKDAGMRFGKCANGKCHCYPK | 3875 |
| GVIINVKCKISRQCLKPCKDAGMRFGKCANGKCACYPK | 3876 |
| GVIINVKCKISRQCLKPCKDAGMRFGKCANGKCGCYPK | 3877 |
| GVIINVKCKISRQCLKPCKDAGMRFGKCANGKCACFPK | 3878 |
| GVIINVKCKISRQCLKPCKDAGMRFGKCANGKCACWPK | 3879 |
| GVIINVKCKISRQCLKPCKEAGMRFGKCANGKCACYPK | 3880 |
| GVIINVKCKISRQCLOPCKDAGMRFGKCANGKCACTPK | 3881 |
| GVIINVKCKISRQCL[hLys]PCKDAGMRFGKCANGKCACTPK | 3882 |
| GVIINVKCKISRQCL[hArg]PCKDAGMRFGKCANGKCACTPK | 3883 |
| GVIINVKCKISRQCL[Cit]PCKDAGMRFGKCANGKCACTPK | 3884 |

TABLE 7G-continued

Additional useful OSK1 peptide analogs: Ala 29 Substituted Series

| Sequence/structure | SEQ ID NO: |
|---|---|
| GVIINVKCKISRQCL[hCit]PCKDAGMRFGKCANGKCHCTPK | 3885 |
| GVIINVKCKISRQCL[Dpr]PCKDAGMRFGKCANGKCACTPK | 3886 |
| GVIINVKCKISRQCL[Dab]PCKDAGMRFGKCANGKCACTPK | 3887 |
| GVIINVKCKISRQCLOPCKDAGMRFGKCANGKCHC | 3888 |
| GVIINVKCKISRQCL[hLys]PCKDAGMRFGKCANGKCHC | 3889 |
| GVIINVKCKISRQCL[hArg]PCKDAGMRFGKCANGKCHC | 3890 |
| GVIINVKCKISRQCL[Cit]PCKDAGMRFGKCANGKCHC | 3891 |
| GVIINVKCKISRQCL[hCit]PCKDAGMRFGKCANGKCHC | 3892 |
| GVIINVKCKISRQCL[Dpr]PCKDAGMRFGKCANGKCHC | 3893 |
| GVIINVKCKISRQCL[Dab]PCKDAGMRFGKCANGKCHC | 3894 |
| GVIINVKCKISRQCLOPCKDAGMRFGKCANGKCAC | 3895 |
| GVIINVKCKISRQCL[hLys]PCKDAGMRFGKCANGKCAC | 3896 |
| GVIINVKCKISRQCL[hArg]PCKDAGMRFGKCANGKCAC | 3897 |
| GVIINVKCKISRQCL[Cit]PCKDAGMRFGKCANGKCAC | 3898 |
| GVIINVKCKISRQCL[hCit]PCKDAGMRFGKCANGKCHC | 3899 |
| GVIINVKCKISRQCL[Dpr]PCKDAGMRFGKCANGKCAC | 3900 |
| GVIINVKCKISRQCL[Dab]PCKDAGMRFGKCANGKCAC | 3901 |
| GVIINVKCKISRQCLKPCKDAGMRFGKCANGKCGCYGG | 3902 |
| GVIINVKCKISRQCLOPCKDAGMRFGKCANGKCHCYGG | 3903 |
| GVIINVKCKISRQCL[hLys]PCKDAGMRFGKCANGKCHCYGG | 3904 |
| GVIINVKCKISRQCL[hArg]PCKDAGMRFGKCANGKCHCYGG | 3905 |
| GVIINVKCKISRQCL[Cit]PCKDAGMRFGKCANGKCHCYGG | 3906 |
| GVIINVKCKISRQCL[hCit]PCKDAGMRFGKCANGKCHCYGG | 3907 |
| GVIINVKCKISRQCL[Dpr]PCKDAGMRFGKCANGKCHCYGG | 3908 |
| GVIINVKCKISRQCLKPCKDAGMRFGKCANGKCACYGG | 3909 |
| GVIINVKCKISRQCLOPCKDAGMRFGKCANGKCACYGG | 3910 |
| GVIINVKCKISRQCL[hLys]PCKDAGMRFGKCANGKCACYGG | 3911 |
| GVIINVKCKISRQCL[hArg]PCKDAGMRFGKCANGKCACYGG | 3912 |
| GVIINVKCKISRQCL[Cit]PCKDAGMRFGKCANGKCACYGG | 3913 |
| GVIINVKCKISRQCL[hCit]PCKDAGMRFGKCANGKCHCYGG | 3914 |
| GVIINVKCKISRQCL[Dpr]PCKDAGMRFGKCANGKCACYGG | 3915 |
| GVIINVKCKISRQCL[Dab]PCKDAGMRFGKCANGKCACYGG | 3916 |
| GVIINVKCKISRQCLKPCKDAGMRFGKCANGKCACYG | 3917 |
| GVIINVKCKISRQCLOPCKDAGMRFGKCANGKCHCGGG | 3918 |
| GVIINVKCKISRQCL[hLys]PCKDAGMRFGKCANGKCHCGGG | 3919 |
| GVIINVKCKISRQCL[hArg]PCKDAGMRFGKCANGKCHCGGG | 3920 |
| GVIINVKCKISRQCL[Cit]PCKDAGMRFGKCANGKCHCGGG | 3921 |
| GVIINVKCKISRQCL[hCit]PCKDAGMRFGKCANGKCHCGGG | 3922 |
| GVIINVKCKISRQCL[Dpr]PCKDAGMRFGKCANGKCHCGGG | 3923 |
| GVIINVKCKISRQCLKPCKDAGMRFGKCANGKCACFGG | 3924 |
| GVIINVKCKISRQCLOPCKDAGMRFGKCANGKCACGGG | 3925 |
| GVIINVKCKISRQCL[hLys]PCKDAGMRFGKCANGKCACGGG | 3926 |
| GVIINVKCKISRQCL[hArg]PCKDAGMRFGKCANGKCACGGG | 3927 |
| GVIINVKCKISRQCL[Cit]PCKDAGMRFGKCANGKCACGGG | 3928 |
| GVIINVKCKISRQCL[hCit]PCKDAGMRFGKCANGKCACGGG | 3929 |
| GVIINVKCKISRQCL[Dpr]PCKDAGMRFGKCANGKCACGGG | 3930 |
| GVIINVKCKISRQCL[Dab]PCKDAGMRFGKCANGKCACGGG | 3931 |
| GVIINVKCKISRQCLKPCKDAGMRFGKCANGKCACGG | 3932 |
| GVIINVKCKISRQCLKPCKDAGMRFGKCANGKCACYG | 3933 |
| GVIINVKCKISRQCLOPCKDAGMRFGKCANGKCACGG | 3934 |
| GVIINVKCKISRQCL[hLys]PCKEAGMRFGKCANGKCHCTPK | 3935 |
| GVIINVKCKISRQCL[hArg]PCKEAGMRFGKCANGKCHCTPK | 3936 |
| GVIINVKCKISRQCL[Cit]PCKEAGMRFGKCANGKCHCTPK | 3937 |
| GVIINVKCKISRQCL[hCit]PCKEAGMRFGKCANGKCHCTPK | 3938 |
| GVIINVKCKISRQCL[Dpr]PCKEAGMRFGKCANGKCHCTPK | 3939 |
| GVIINVKCKISRQCL[Dab]PCKEAGMRFGKCANGKCHCTPK | 3940 |
| GVIINVKCKISRQCLOPCKEAGMRFGKCANGKCHCYPK | 3941 |
| GVIINVKCKISRQCL[hLys]PCKEAGMRFGKCANGKCHCYPK | 3942 |
| GVIINVKCKISRQCL[hArg]PCKEAGMRFGKCANGKCHCYPK | 3943 |
| GVIINVKCKISRQCL[Cit]PCKEAGMRFGKCANGKCHCYPK | 3944 |
| GVIINVKCKISRQCL[hCit]PCKEAGMRFGKCANGKCHCYPK | 3945 |
| GVIINVKCKISRQCL[Dpr]PCKEAGMRFGKCANGKCHCYPK | 3946 |
| GVIINVKCKISRQCL[Dab]PCKEAGMRFGKCANGKCHCYPK | 3947 |
| GVIINVKCKISRQCLOPCKEAGMRFGKCANGKCACTPK | 3948 |
| GVIINVKCKISRQCL[hLys]PCKEAGMRFGKCANGKCACTPK | 3949 |
| GVIINVKCKISRQCL[hArg]PCKEAGMRFGKCANGKCACTPK | 3950 |
| GVIINVKCKISRQCL[Cit]PCKEAGMRFGKCANGKCACTPK | 3951 |
| GVIINVKCKISRQCL[hCit]PCKEAGMRFGKCANGKCHCTPK | 3952 |
| GVIINVKCKISRQCL[Dpr]PCKEAGMRFGKCANGKCACTPK | 3953 |
| GVIINVKCKISRQCL[Dab]PCKEAGMRFGKCANGKCACTPK | 3954 |
| GVIINVKCKISRQCLOPCKEAGMRFGKCANGKCHC | 3955 |
| GVIINVKCKISRQCL[hLys]PCKEAGMRFGKCANGKCHC | 3956 |

TABLE 7G-continued

Additional useful OSK1 peptide analogs: Ala 29 Substituted Series

| Sequence/structure | SEQ ID NO: |
|---|---|
| GVIINVKCKISRQCL[hArg]PCKEAGMRFGKCANGKCHC | 3957 |
| GVIINVKCKISRQCL[Cit]PCKEAGMRFGKCANGKCHC | 3958 |
| GVIINVKCKISRQCL[hCit]PCKEAGMRFGKCANGKCHC | 3959 |
| GVIINVKCKISRQCL[Dpr]PCKEAGMRFGKCANGKCHC | 3960 |
| GVIINVKCKISRQCLOPCKEAGMRFGKCANGKCAC | 3961 |
| GVIINVKCKISRQCL[hLys]PCKEAGMRFGKCANGKCAC | 3962 |
| GVIINVKCKISRQCL[hArg]PCKEAGMRFGKCANGKCAC | 3963 |
| GVIINVKCKISRQCL[Cit]PCKEAGMRFGKCANGKCAC | 3964 |
| GVIINVKCKISRQCL[hCit]PCKEAGMRFGKCANGKCHC | 3965 |
| GVIINVKCKISRQCL[Dpr]PCKEAGMRFGKCANGKCAC | 3966 |
| GVIINVKCKISRQCL[Dab]PCKEAGMRFGKCANGKCAC | 3967 |
| GVIINVKCKISRQCLKPCKEAGMRFGKCANGKCHCYGG | 3968 |
| GVIINVKCKISRQCLOPCKEAGMRFGKCANGKCHCYGG | 3969 |
| GVIINVKCKISRQCLKPCKEAGMRFGKCANGKCHCYG | 3970 |
| GVIINVKCKISRQCLKPCKEAGMRFGKCANGKCACYG | 3971 |
| GVIINVKCKISRQCL[hLys]PCKEAGMRFGKCANGKCHCYGG | 3972 |
| GVIINVKCKISRQCL[hArg]PCKEAGMRFGKCANGKCHCYCG | 3973 |
| GVIINVKCKISRQCL[Cit]PCKEAGMRFGKCANGKCHCYGG | 3974 |
| GVIINVKCKISRQCL[hCit]PCKEAGMRFGKCANGKCHCYGG | 3975 |
| GVIINVKCKISRQCL[Dpr]PCKEAGMRFGKCANGKCHCYGG | 3976 |
| GVIINVKCKISRQCL[Dab]PCKEAGMRFGKCANGKCHCYGG | 3977 |
| GVIINVKCKISRQCLKPCKEAGMRFGKCANGKCACYG | 3978 |
| GVIINVKCKISRQCLOPCKEAGMRFGKCANGKCACYGG | 3979 |
| GVIINVKCKISRQCL[hLys]PCKEAGMRFGKCANGKCACYGG | 3980 |
| GVIINVKCKISRQCL[hArg]PCKEAGMRFGKCANGKCACYGG | 3981 |
| GVIINVKCKISRQCL[Cit]PCKEAGMRFGKCANGKCACYGG | 3982 |
| GVIINVKCKISRQCL[hCit]PCKEAGMRFGKCANGKCHCYGG | 3983 |
| GVIINVKCKISRQCL[Dpr]PCKEAGMRFGKCANGKCACYGG | 3984 |
| GVIINVKCKISRQCL[Dab]PCKEAGMRFGKCANGKCACYGG | 3985 |
| GVIINVKCKISRQCLKPCKEAGMRFGKCANGKCACFGG | 3986 |
| GVIINVKCKISRQCLOPCKEAGMRFGKCANGKCHCGGG | 3987 |
| GVIINVKCKISRQCL[hLys]PCKEAGMRFGKCANGKCHCGGG | 3988 |
| GVIINVKCKISRQCL[hArg]PCKEAGMRFGKCANGKCHCGGG | 3989 |
| GVIINVKCKISRQCL[Cit]PCKEAGMRFGKCANGKCHCGGG | 3990 |
| GVIINVKCKISRQCL[hCit]PCKEAGMRFGKCANGKCHCGGG | 3991 |
| GVIINVKCKISRQCL[Dpr]PCKEAGMRFGKCANGKCHCGGG | 3992 |

TABLE 7G-continued

Additional useful OSK1 peptide analogs: Ala 29 Substituted Series

| Sequence/structure | SEQ ID NO: |
|---|---|
| GVIINVKCKISRQCLOPCKEAGMRFGKCANGKCACGGG | 3993 |
| GVIINVKCKISRQCL[hLys]PCKEAGMRFGKCANGKCACGGG | 3994 |
| GVIINVKCKISRQCL[hArg]PCKEAGMRFGKCANGKCACGGG | 3995 |
| GVIINVKCKISRQCL[Cit]PCKEAGMRFGKCANGKCACGGG | 3996 |
| GVIINVKCKISRQCL[hCit]PCKEAGMRFGKCANGKCACTP | 3997 |
| GVIINVKCKISRQCL[Dpr]PCKEAGMRFGKCANGKCACTP | 3998 |
| GVIINVKCKISRQCL[Dab]PCKEAGMRFGKCANGKCACTP | 3999 |
| GVIINVKCKISRQCLOPCKDAGMRFGKCANGKCHCTPK-amide | 4000 |
| GVIINVKCKISRQCL[hLys]PCKDAGMRFGKCANGKCHCTPK-amide | 4001 |
| GVIINVKCKISRQCL[hArg]PCKDAGMRFGKCANGKCHCTPK-amide | 4002 |
| GVIINVKCKISRQCL[Cit]PCKDAGMRFGKCANGKCHCTPK-amide | 4003 |
| GVIINVKCKISRQCL[hCit]PCKDAGMRFGKCANGKCHCTPK-amide | 4004 |
| GVIINVKCKISRQCL[Dpr]PCKDAGMRFGKCANGKCHCTPK-amide | 4005 |
| GVIINVKCKISRQCL[Dab]PCKDAGMRFGKCANGKCHCTPK-amide | 4006 |
| GVIINVKCKISRQCLOPCKDAGMRFGKCANGKCHCYPK-amide | 4007 |
| GVIINVKCKISRQCL[hLys]PCKDAGMRFGKCANGKCHCYPK-amide | 4008 |
| GVIINVKCKISRQCL[hArg]PCKDAGMRFGKCANGKCHCYPK-amide | 4009 |
| GVIINVKCKISRQCL[Cit]PCKDAGMRFGKCANGKCHCYPK-amide | 4010 |
| GVIINVKCKISRQCL[hCit]PCKDAGMRFGKCANGKCHCYPK-amide | 4011 |
| GVIINVKCKISRQCL[Dpr]PCKDAGMRFGKCANGKCHCYPK-amide | 4012 |
| GVIINVKCKISRQCL[Dab]PCKDAGMRFGKCANGKCHCYPK-amide | 4013 |
| GVIINVKCKISRQCLOPCKDAGMRFGKCANGKCACTPK-amide | 4014 |
| GVIINVKCKISRQCL[hLys]PCKDAGMRFGKCANGKCACTPK-amide | 4015 |
| GVIINVKCKISRQCL[hArg]PCKDAGMRFGKCANGKCACTPK-amide | 4016 |
| GVIINVKCKISRQCL[Cit]PCKDAGMRFGKCANGKCACTPK-amide | 4017 |
| GVIINVKCKISRQCL[hCit]PCKDAGMRFGKCANGKCACTPK-amide | 4018 |
| GVIINVKCKISRQCL[Dpr]PCKDAGMRFGKCANGKCACTPK-amide | 4019 |

TABLE 7G-continued

Additional useful OSK1 peptide analogs: Ala 29 Substituted Series

| Sequence/structure | SEQ ID NO: |
|---|---|
| GVIINVKCKISRQCL[Dab]PCKDAGMRFGKCANGKCACTPK-amide | 4020 |
| GVIINVKCKISRQCLOPCKDAGMRFGKCANGKCHC-amide | 4021 |
| GVIINVKCKISRQCL[hLys]PCKDAGMRFGKCANGKCHC-amide | 4022 |
| GVIINVKCKISRQCL[hArg]PCKDAGMRFGKCANGKCHC-amide | 4023 |
| GVIINVKCKISRQCL[Cit]PCKDAGMRFGKCANGKCHC-amide | 4024 |
| GVIINVKCKISRQCL[hCit]PCKDAGMRFGKCANGKCHC-amide | 4025 |
| GVIINVKCKISRQCL[Dpr]PCKDAGMRFGKCANGKCHC-amide | 4026 |
| GVIINVKCKISRQCLOPCKDAGMRFGKCANGKCAC-amide | 4027 |
| GVIINVKCKISRQCL[hLys]PCKDAGMRFGKCANGKCAC-amide | 4028 |
| GVIINVKCKISRQCL[hArg]PCKDAGMRFGKCANGKCAC-amide | 4029 |
| GVIINVKCKISRQCL[Cit]PCKDAGMRFGKCANGKCAC-amide | 4030 |
| GVIINVKCKISRQCL[hCit]PCKDAGMRFGKCANGKCHC-amide | 4031 |
| GVIINVKCKISRQCL[Dpr]PCKDAGMRFGKCANGKCAC-amide | 4032 |
| GVIINVKCKISRQCL[Dab]PCKDAGMRFGKCANGKCAC-amide | 4033 |
| GVIINVKCKISRQCLKPCKDAGMRFGKCANGKCHCYGG-amide | 4034 |
| GVIINVKCKISRQCLOPCKDAGMRFGKCANGKCHCYGG-amide | 4035 |
| GVIINVKCKISRQCL[hLys]PCKDAGMRFGKCANGKCHCYGG-amide | 4036 |
| GVIINVKCKISRQCL[hArg]PCKDAGMRFGKCANGKCHCYGG-amide | 4037 |
| GVIINVKCKISRQCL[Cit]PCKDAGMRFGKCANGKCHCYGG-amide | 4038 |
| GVIINVKCKISRQCL[hCit]PCKDAGMRFGKCANGKCHCYGG-amide | 4039 |
| GVIINVKCKISRQCL[Dpr]PCKDAGMRFGKCANGKCHCYGG-amide | 4040 |
| GVIINVKCKISRQCLKPCKDAGMRFGKCANGKCHCFGG-amide | 4041 |
| GVIINVKCKISRQCLKPCKDAGMRFGKCANGKCHCYG-amide | 4042 |
| GVIINVKCKISRQCLKPCKDAGMRFGKCANGKCACYG-amide | 4043 |
| GVIINVKCKISRQCLOPCKDAGMRFGKCANGKCACYGG-amide | 4044 |
| GVIINVKCKISRQCL[hLys]PCKDAGMRFGKCANGKCACYGG-amide | 4045 |
| GVIINVKCKISRQCL[hArg]PCKDAGMRFGKCANGKCACYGG-amide | 4046 |
| GVIINVKCKISRQCL[Cit]PCKDAGMRFGKCANGKCACYGG-amide | 4047 |
| GVIINVKCKISRQCL[hCit]PCKDAGMRFGKCANGKCACYGG-amide | 4048 |
| GVIINVKCKISRQCL[Dpr]PCKDAGMRFGKCANGKCACYGG-amide | 4049 |
| GVIINVKCKISRQCL[Dab]PCKDAGMRFGKCANGKCACYGG-amide | 4050 |
| GVIINVKCKISRQCLKPCKDAGMRFGKCANGKCACYGG-amide | 4051 |
| GVIINVKCKISRQCLOPCKDAGMRFGKCANGKCHCGGG-amide | 4052 |
| GVIINVKCKISRQCL[hLys]PCKDAGMRFGKCANGKCHCGGG-amide | 4053 |
| GVIINVKCKISRQCL[hArg]PCKDAGMRFGKCANGKCHCGGG-amide | 4054 |
| GVIINVKCKISRQCL[Cit]PCKDAGMRFGKCANGKCHCGGG-amide | 4055 |
| GVIINVKCKISRQCL[hCit]PCKDAGMRFGKCANGKCHCGGG-amide | 4056 |
| GVIINVKCKISRQCL[Dpr]PCKDAGMRFGKCANGKCHCGGG-amide | 4057 |
| GVIINVKCKISRQCLKPCKDAGMRFGKCANGKCACGGG-amide | 4058 |
| GVIINVKCKISRQCLOPCKDAGMRFGKCANGKCACFGG-amide | 4059 |
| GVIINVKCKISRQCLOPCKDAGMRFGKCANGKCACGGG-amide | 4060 |
| GVIINVKCKISRQCL[hLys]PCKDAGMRFGKCANGKCACGGG-amide | 4061 |
| GVIINVKCKISRQCL[hArg]PCKDAGMRFGKCANGKCACGGG-amide | 4062 |
| GVIINVKCKISRQCL[Cit]PCKDAGMRFGKCANGKCACGGG-amide | 4063 |
| GVIINVKCKISRQCL[hCit]PCKDAGMRFGKCANGKCACGGG-amide | 4064 |
| GVIINVKCKISRQCL[Dpr]PCKDAGMRFGKCANGKCACGGG-amide | 4065 |
| GVIINVKCKISRQCL[Dab]PCKDAGMRFGKCANGKCACGGG-amide | 4066 |
| GVIINVKCKISRQCLOPCKEAGMRFGKCANGKCHCTPK-amide | 4067 |
| GVIINVKCKISRQCL[hLys]PCKEAGMRFGKCANGKCHCTPK-amide | 4068 |
| GVIINVKCKISRQCL[hArg]PCKEAGMRFGKCANGKCHCTPK-amide | 4069 |
| GVIINVKCKISRQCL[Cit]PCKEAGMRFGKCANGKCHCTPK-amide | 4070 |
| GVIINVKCKISRQCL[hCit]PCKEAGMRFGKCANGKCHCTPK-amide | 4071 |
| GVIINVKCKISRQCL[Dpr]PCKEAGMRFGKCANGKCHCTPK-amide | 4072 |
| GVIINVKCKISRQCL[Dab]PCKEAGMRFGKCANGKCHCTPK-amide | 4073 |

TABLE 7G-continued

Additional useful OSK1 peptide analogs: Ala 29 Substituted Series

| Sequence/structure | SEQ ID NO: |
|---|---|
| GVIINVKCKISRQCLOPCKEAGMRFGKCANGKCHCYPK-amide | 4074 |
| GVIINVKCKISRQCL[hLys]PCKEAGMRFGKCANGKCHCYPK-amide | 4075 |
| GVIINVKCKISRQCL[hArg]PCKEAGMRFGKCANGKCHCYPK-amide | 4076 |
| GVIINVKCKISRQCL[Cit]PCKEAGMRFGKCANGKCHCYPK-amide | 4077 |
| GVIINVKCKISRQCL[hCit]PCKEAGMRFGKCANGKCHCYPK-amide | 4078 |
| GVIINVKCKISRQCL[Dpr]PCKEAGMRFGKCANGKCHCYPK-amide | 4079 |
| GVIINVKCKISRQCL[Dab]PCKEAGMRFGKCANGKCHCYPK-amide | 4080 |
| GVIINVKCKISRQCLOPCKEAGMRFGKCANGKCACTPK-amide | 4081 |
| GVIINVKCKISRQCL[hLys]PCKEAGMRFGKCANGKCACTPK-amide | 4082 |
| GVIINVKCKISRQCL[hArg]PCKEAGMRFGKCANGKCACTPK-amide | 4083 |
| GVIINVKCKISRQCL[Cit]PCKEAGMRFGKCANGKCACTPK-amide | 4084 |
| GVIINVKCKISRQCL[hCit]PCKEAGMRFGKCANGKCACTPK-amide | 4085 |
| GVIINVKCKISRQCL[Dpr]PCKEAGMRFGKCANGKCACTPK-amide | 4086 |
| GVIINVKCKISRQCL[Dab]PCKEAGMRFGKCANGKCACTPK-amide | 4087 |
| GVIINVKCKISRQCLOPCKEAGMRFGKCANGKCHC-amide | 4088 |
| GVIINVKCKISRQCL[hLys]PCKEAGMRFGKCANGKCHC-amide | 4089 |
| GVIINVKCKISRQCL[hArg]PCKEAGMRFGKCANGKCHC-amide | 4090 |
| GVIINVKCKISRQCL[Cit]PCKEAGMRFGKCANGKCHC-amide | 4091 |
| GVIINVKCKISRQCL[hCit]PCKEAGMRFGKCANGKCHC-amide | 4092 |
| GVIINVKCKISRQCL[Dpr]PCKEAGMRFGKCANGKCHC-amide | 4093 |
| GVIINVKCKISRQCLOPCKEAGMRFGKCANGKCAC-amide | 4094 |
| GVIINVKCKISRQCL[hLys]PCKEAGMRFGKCANGKCAC-amide | 4095 |
| GVIINVKCKISRQCL[hArg]PCKEAGMRFGKCANGKCAC-amide | 4096 |
| GVIINVKCKISRQCL[Cit]PCKEAGMRFGKCANGKCAC-amide | 4097 |
| GVIINVKCKISRQCL[hCit]PCKEAGMRFGKCANGKCHC-amide | 4098 |
| GVIINVKCKISRQCL[Dpr]PCKEAGMRFGKCANGKCAC-amide | 4099 |
| GVIINVKCKISRQCL[Dab]PCKEAGMRFGKCANGKCAC-amide | 4100 |
| GVIINVKCKISRQCLKPCKEAGMRFGKCANGKCHCWGG-amide | 4101 |
| GVIINVKCKISRQCLOPCKEAGMRFGKCANGKCHCYGG-amide | 4102 |
| GVIINVKCKISRQCL[hLys]PCKEAGMRFGKCANGKCHCYGG-amide | 4103 |
| GVIINVKCKISRQCL[hArg]PCKEAGMRFGKCANGKCHCYGG-amide | 4104 |
| GVIINVKCKISRQCL[Cit]PCKEAGMRFGKCANGKCHCYGG-amide | 4105 |
| GVIINVKCKISRQCL[hCit]PCKEAGMRFGKCANGKCHCYGG-amide | 4106 |
| GVIINVKCKISRQCL[Dpr]PCKEAGMRFGKCANGKCHCYGG-amide | 4107 |
| GVIINVKCKISRQCL[Dab]PCKEAGMRFGKCANGKCHCYGG-amide | 4108 |
| GVIINVKCKISRQCLKPCKEAGMRFGKCANGKCACYGG-amide | 4109 |
| GVIINVKCKISRQCLOPCKEAGMRFGKCANGKCACYGG-amide | 4110 |
| GVIINVKCKISRQCL[hLys]PCKEAGMRFGKCANGKCACYGG-amide | 4111 |
| GVIINVKCKISRQCL[hArg]PCKEAGMRFGKCANGKCACYGG-amide | 4112 |
| GVIINVKCKISRQCL[Cit]PCKEAGMRFGKCANGKCACYGG-amide | 4113 |
| GVIINVKCKISRQCL[hCit]PCKEAGMRFGKCANGKCHCYGG-amide | 4114 |
| GVIINVKCKISRQCL[Dpr]PCKEAGMRFGKCANGKCACYGG-amide | 4115 |
| GVIINVKCKISRQCL[Dab]PCKEAGMRFGKCANGKCACYGG-amide | 4116 |
| GVIINVKCKISRQCLOPCKEAGMRFGKCANGKCHCGGG-amide | 4117 |
| GVIINVKCKISRQCL[hLys]PCKEAGMRFGKCANGKCHCGGG-amide | 4118 |
| GVIINVKCKISRQCL[hArg]PCKEAGMRFGKCANGKCHCGGG-amide | 4119 |
| GVIINVKCKISRQCL[Cit]PCKEAGMRFGKCANGKCHCGGG-amide | 4120 |
| GVIINVKCKISRQCL[hCit]PCKEAGMRFGKCANGKCHCGGG-amide | 4121 |
| GVIINVKCKISRQCL[Dpr]PCKEAGMRFGKCANGKCHCGGG-amide | 4122 |
| GVIINVKCKISRQCLOPCKEAGMRFGKCANGKCACGGG-amide | 4123 |
| GVIINVKCKISRQCL[hLys]PCKEAGMRFGKCANGKCACGGG-amide | 4124 |
| GVIINVKCKISRQCL[hArg]PCKEAGMRFGKCANGKCACGGG-amide | 4125 |
| GVIINVKCKISRQCL[Cit]PCKEAGMRFGKCANGKCACGGG-amide | 4126 |

TABLE 7G-continued

| Additional useful OSK1 peptide analogs: Ala 29 Substituted Series | |
|---|---|
| Sequence/structure | SEQ ID NO: |
| GVIINVKCKISRQCL[hCit]PCKEAGMRFGKCANGKCACTP-amide | 4127 |
| GVIINVKCKISRQCL[Dpr]PCKEAGMRFGKCANGKCACGGG-amide | 4128 |
| GVIINVKCKISRQCL[Dab]PCKEAGMRFGKCANGKCACGGG-amide | 4129 |
| GVIINVKCKISRQCLKPCK[Cpa]AGMRFGKCANGKCACYGG-amide | 4130 |
| GVIINVKCKISRQCLKPCK[Cpa]AGMRFGKCANGKCACGGG-amide | 4131 |
| GVIINVKCKISRQCLKPCK[Cpa]AGMRFGKCANGKCACY-amide | 4132 |
| Ac-GVIINVKCKISRQCLKPCKDAGMRFGKCANGKCACYGG-amide | 4133 |
| GVIINVKCKISRQCLKPCK[Aad]AGMRFGKCANGKCACYGG-amide | 4134 |
| GVIINVKCKISRQCLKPCK[Aad]AGMRFGKCANGKCHCYGG-amide | 4135 |
| GVIINVKCKISRQCLKPCK[Aad]ACMRFGKCANGKCACYGG | 4136 |
| GVIINVKCKISRQCLHPCKDAGMRFGKCANGKCACYGG-amide | 4137 |
| GVIINVKCKISRQCLHPCKDAGMRFGKCANGKCACYGG | 4138 |
| GVIINVKCKISRQCLHPCKDAGMRFGKCANGKCACY-amide | 4139 |
| GVIINVKCKISRQCLHPCKDAGMRFGKCANGKCHCYGG-amide | 4140 |
| GVIINVKCKISRQCLHPCKDAGMRFGKCANGKCHCYGG | 4141 |
| GVIINVKCKISRQCLHPCKDAGMRFGKCANGKCHCYPK | 4142 |
| GVIINVKCKISRQCLHPCKDAGMRFGKCANGKCAC | 4143 |
| GVIINVKCKISRQCLKPCKDAGMRFGKCANGKCAC[1Nal]GG-amide | 4144 |
| GVIINVKCKISRQCLKPCKDAGMRFGKCANGKCAC[1Nal]PK-amide | 4145 |
| GVIINVKCKISRQCLKPCKDAGMRFGKCANGKCAC[2Nal]GG-amide | 4146 |
| GVIINVKCKISRQCLKPCKDAGMRFGKCANGKCAC[Cha]GG-amide | 4147 |
| GVIINVKCKISRQCLKPCKDAGMRFGKCANGKCAC[MePhe]GG-amide | 4148 |
| GVIINVKCKISRQCLKPCKDAGMRFGKCANGKCAC[BiPhA]GG-amide | 4149 |
| GVIINVKCKISRQCLKPCKDAGMRFGKCANGKC[Aib]CYGG-amide | 4150 |
| GVIINVKCKISRQCLKPCKDAGMRFGKCANGKC[Abu]CYGG-amide | 4151 |
| GVIINVKCKISRQCLKPCKDAGMRFGKCANGKCAC[1Nal] | 4152 |
| GVIINVKCKISRQCLHPCKDAGMRFGKCANGKCAC[1Nal]GG-amide | 4153 |
| GVIINVKCKISRQCLKPCKDAGMRFGKCANGKCAC[4Bip]-amide | 4154 |
| GVIINVKCKISRQCLHPCKDAGMRFGKCANGKCAC[4Bip]GG-amide | 4155 |
| GVIINVKCKISRQCLKPCKDAGMRFGKCANGKCHCGGG | 4156 |

TABLE 7H

| Additional useful OSK1 peptide analogs: Ala 30 Substituted Series | |
|---|---|
| Sequence/structure | SEQ ID NO: |
| GVIINVKCKISRQCLEPCKKAGMRFGKCMAGKCHCTPK | 4157 |
| GVIINVSCKISRQCLEPCKKAGMRFGKCMAGKCHCTPK | 4158 |
| GVIINVKCKISRQCLKPCKKAGMRFGKCMAGKCHCTPK | 4159 |
| GVIINVKCKISRQCLEPCKDAGMRFGKCMAGKCHCTPK | 4160 |
| GVIINVKCKISRQCLKPCKDAGMRFGKCMAGKCHCTPK | 4161 |
| GVIINVSCKISRQCLKPCKDAGMRFGKCMAGKCHCTPK | 4162 |
| GVIINVKCKISPQCLKPCKDAGMRFGKCMAGKCHCTPK | 4163 |
| GVIINVKCKISRQCLKPCKDAGMRFGKCMAGKCHCYPK | 4164 |
| Ac-GVIINVKCKISPQCLKPCKDAGMRFGKCMAGKCHCTPK | 4165 |
| GVIINVKCKISPQCLKPCKDAGMRFGKCMAGKCHCTPK-amide | 4166 |
| Ac-GVIINVKCKISPQCLKPCKDAGMRFGKCMAGKCHCTPK-amide | 4167 |
| GVIINVKCKISRQCLKPCKDAGMRFGKCMAGKCHCYPK-amide | 4168 |
| Ac-GVIINVKCKISRQCLKPCKDAGMRFGKCMAGKCHCYPK | 4169 |
| Ac-GVIINVKCKISRQCLKPCKDAGMRFGKCMAGKCHCYPK-amide | 4170 |
| GVIINVKCKISRQCLKPCKKAGMRFGKCMAGKCHCTPK-amide | 4171 |
| Ac-GVIINVKCKISRQCLKPCKKAGMRFGKCMAGKCHCTPK | 4172 |
| Ac-GVIINVKCKISRQCLKPCKKAGMRFGKCMAGKCHCTPK-amide | 4173 |
| Ac-GVIINVKCKISRQCLEPCKDAGMRFGKCMAGKCHCTPK | 4174 |
| GVIINVKCKISRQCLEPCKDAGMRFGKCMAGKCHCTPK-amide | 4175 |
| Ac-GVIINVKCKISRQCLEPCKDAGMRFGKCMAGKCHCTPK-amide | 4176 |
| GVIINVKCKISRQCLEPCKKAGMRFGKCMAGKCHCTPK-amide | 4177 |
| Ac-GVIINVKCKISRQCLEPCKKAGMRFGKCMAGKCHCTPK | 4178 |
| Ac-GVIINVKCKISRQCLEPCKKAGMRFGKCMAGKCHCTPK-amide | 4179 |
| GVIINVKCKISRQCLKPCKDAGMRFGKCMAGKCHCTPK-amide | 4180 |

TABLE 7H-continued

Additional useful OSK1 peptide analogs: Ala 30 Substituted Series

| Sequence/structure | SEQ ID NO: |
|---|---|
| Ac-GVIINVKCKISRQCLKPCKDAGMRFGKCMAGKCHCTPK | 4181 |
| Ac-GVIINVKCKISRQCLKPCKDAGMRFGKCMAGKCHCTPK-amide | 4182 |
| VIINVKCKISRQCLEPCKKAGMRFGKCMAGKCHCTPK | 4183 |
| Ac-VIINVKCKISRQCLEPCKKAGMRFGKCMAGKCHCTPK | 4184 |
| VIINVKCKISRQCLEPCKKAGMRFGKCMAGKCHCTPK-amide | 4185 |
| Ac-VIINVKCKISRQCLEPCKKAGMRFGKCMAGKCHCTPK-amide | 4186 |
| GVIINVKCKISRQCLEPCKKAGMRFGKCMAGKCACTPK | 4187 |
| Ac-GVIINVKCKISRQCLEPCKKAGMRFGKCMAGKCACTPK | 4188 |
| GVIINVKCKISRQCLEPCKKAGMRFGKCMAGKCACTPK-amide | 4189 |
| Ac-GVIINVKCKISRQCLEPCKKAGMRFGKCMAGKCACTPK-amide | 4190 |
| VIINVKCKISRQCLKPCKDAGMRFGKCMAGKCHCTPK | 4191 |
| Ac-VIINVKCKISRQCLKPCKDAGMRFGKCMAGKCHCTPK | 4192 |
| VIINVKCKISRQCLKPCKDAGMRFGKCMAGKCHCTPK-amide | 4193 |
| Ac-VIINVKCKISRQCLKPCKDAGMRFGKCMAGKCHCTPK-amide | 4194 |
| NVKCKISRQCLKPCKDAGMRFGKCMAGKCHCTPK | 4195 |
| Ac-NVKCKISRQCLKPCKDAGMRFGKCMAGKCHCTPK | 4196 |
| NVKCKISRQCLKPCKDAGMRFGKCMAGKCHCTPK-amide | 4197 |
| Ac-NVKCKISRQCLKPCKDAGMRFGKCMAGKCHCTPK-amide | 4198 |
| KCKISRQCLKPCKDAGMRFGKCMAGKCHCTPK | 4199 |
| Ac-KCKISRQCLKPCKDAGMRFGKCMAGKCHCTPK | 4200 |
| KCKISRQCLKPCKDAGMRFGKCMAGKCHCTPK-amide | 4201 |
| Ac-KCKISRQCLKPCKDAGMRFGKCMAGKCHCTPK-amide | 4202 |
| CKISRQCLKPCKDAGMRFGKCMAGKCHCTPK | 4203 |
| Ac-CKISRQCLKPCKDAGMRFGKCMAGKCHCTPK | 4204 |
| CKISRQCLKPCKDAGMRFGKCMAGKCHCTPK-amide | 4205 |
| Ac-CKISRQCLKPCKDAGMRFGKCMAGKCHCTPK-amide | 4206 |
| GVIINVKCKISRQCLKPCKDAGMRNGKCMAGKCHCTPK | 4207 |
| GVIINVKCKISRQCLKPCKDAGMRNGKCMAGKCHCTPK-amide | 4208 |
| Ac-GVIINVKCKISRQCLKPCKDAGMRNGKCMAGKCHCTPK | 4209 |
| Ac-GVIINVKCKISRQCLKPCKDAGMRNGKCMAGKCHCTPK-amide | 4210 |
| GVIINVKCKISRQCLKPCKDAGMRFGKCMNRKCHCTPK | 4211 |
| GVIINVKCKISRQCLKPCKDAGMRFGKCMNRKCHCTPK-amide | 4212 |
| Ac-GVIINVKCKISRQCLKPCKDAGMRFGKCMNRKCHCTPK | 4213 |
| Ac-GVIINVKCKISRQCLKPCKDAGMRFGKCMNRKCHCTPK-amide | 4214 |
| GVIINVKCKISKQCLKPCRDAGMRFGKCMAGKCHCTPK | 4215 |
| Ac-GVIINVKCKISKQCLKPCRDAGMRFGKCMAGKCHCTPK | 4216 |
| GVIINVKCKISKQCLKPCRDAGMRFGKCMAGKCHCTPK-amide | 4217 |
| Ac-GVIINVKCKISKQCLKPCRDAGMRFGKCMAGKCHCTPK-amide | 4218 |
| TIINVKCKISRQCLKPCKDAGMRFGKCMAGKCHCTPK | 4219 |
| Ac-TIINVKCKISRQCLKPCKDAGMRFGKCMAGKCHCTPK | 4220 |
| TIINVKCKISRQCLKPCKDAGMRFGKCMAGKCHCTPK-amide | 4221 |
| Ac-TIINVKCKISRQCLKPCKDAGMRFGKCMAGKCHCTPK-amide | 4222 |
| GVKINVKCKISRQCLEPCKKAGMRFGKCMAGKCHCTPK | 4223 |
| Ac-GVKINVKCKISRQCLEPCKKAGMRFGKCMAGKCHCTPK | 4224 |
| GVKINVKCKISRQCLEPCKKAGMRFGKCMAGKCHCTPK-amide | 4225 |
| Ac-GVKINVKCKISRQCLEPCKKAGMRFGKCMAGKCHCTPK-amide | 4226 |
| GVKINVKCKISRQCLEPCKKAGMRFGKCMAGKCACTPK | 4227 |
| GVKINVKCKISRQCLKPCKDAGMRFGKCMAGKCHCTPK | 4228 |
| GVKINVKCKISRQCLKPCKDAGMRFGKCMAGKCACTPK | 4229 |
| Ac-GVKINVKCKISRQCLEPCKKAGMRFGKCMAGKCACTPK | 4230 |
| GVKINVKCKISRQCLEPCKKAGMRFGKCMAGKCACTPK-amide | 4231 |
| Ac-GVKINVKCKISRQCLEPCKKAGMRFGKCMAGKCACTPK-amide | 4232 |
| Ac-GVKINVKCKISRQCLKPCKDAGMRFGKCMAGKCACTPK | 4233 |
| GVKINVKCKISRQCLKPCKDAGMRFGKCMAGKCACTPK-amide | 4234 |
| Ac-GVKINVKCKISRQCLKPCKDAGMRFGKCMAGKCACTPK-amide | 4235 |
| Ac-GVKINVKCKISRQCLKPCKDAGMRFGKCMAGKCHCTPK | 4236 |
| GVKINVKCKISRQCLKPCKDAGMRFGKCMAGKCHCTPK-amide | 4237 |
| Ac-GVKINVKCKISRQCLKPCKDAGMRFGKCMAGKCHCTPK-amide | 4238 |
| GVIINVKCKISRQCLKPCKDAGMRFGKCMAGKCHCT | 4239 |
| GVIINVKCKISRQCLOPCKDAGMRFGKCMACKCHCTPK | 4240 |
| GVIINVKCKISRQCL[hLys]PCKDAGMRFGKCMAGKCHCTPK | 4241 |
| GVIINVKCKISRQCL[hArg]PCKDAGMRFGKCMAGKCHCTPK | 4242 |
| GVIINVKCKISRQCL[Cit]PCKDAGMRFGKCMAGKCHCTPK | 4243 |
| GVIINVKCKISRQCL[hCit]PCKDAGMRFGKCMAGKCHCTPK | 4244 |
| GVIINVKCKISRQCL[Dpr]PCKDAGMRFGKCMAGKCHCTPK | 4245 |
| GVIINVKCKISRQCL[Dab]PCKDAGMRFGKCMAGKCHCTPK | 4246 |

TABLE 7H-continued

Additional useful OSK1 peptide analogs: Ala 30 Substituted Series

| Sequence/structure | SEQ ID NO: |
|---|---|
| GVIINVKCKISRQCLOPCKDAGMRFGKCMAGKCHCYPK | 4247 |
| GVIINVKCKISRQCL[hLys]PCKDAGMRFGKCMAGKCHCYPK | 4248 |
| GVIINVKCKISRQCL[hArg]PCKDACMRFGKCMACKCHCYPK | 4249 |
| GVIINVKCKISRQCL[Cit]PCKDAGMRFGKCMAGKCHCYPK | 4250 |
| GVIINVKCKISRQCL[hCit]PCKDAGMRFGKCMAGKCHCYPK | 4251 |
| GVIINVKCKISRQCL[Dpr]PCKDAGMRFGKCMAGKCHCYPK | 4252 |
| GVIINVKCKISRQCL[Dab]PCKDAGMRFGKCMAGKCHCYPK | 4253 |
| GVIINVKCKISRQCLKPCKDAGMRFGKCMAGKCACYPK | 4254 |
| GVIINVKCKISRQCLKPCKDAGMRFGKCMAGKCGCYPK | 4255 |
| GVIINVKCKISRQCLKPCKDAGMRFGKCMAGKCACEPK | 4256 |
| GVIINVKCKISRQCLKPCKDAGMRFGKCMAGKCACWPK | 4257 |
| GVIINVKCKISRQCLKPCKEAGMRFGKCMAGKCACYPK | 4258 |
| GVIINVKCKISRQCLOPCKDAGMRFGKCMAGKCACTPK | 4259 |
| GVIINVKCKISRQCL[hLys]PCKDAGMREGKCMAGKCACTPK | 4260 |
| GVIINVKCKISRQCL[hArg]PCKDAGMRFGKCMAGKCACTPK | 4261 |
| GVIINVKCKISRQCL[Cit]PCKDAGMRFGKCMAGKCACTPK | 4262 |
| GVIINVKCKISRQCL[hCit]PCKDAGMRFGKCMAGKCHCTPK | 4263 |
| GVIINVKCKISRQCL[Dpr]PCKDAGMRFGKCMAGKCACTPK | 4264 |
| GVIINVKCKISRQCL[Dab]PCKDAGMRFGKCMAGKCACTPK | 4265 |
| GVIINVKCKISRQCLOPCKDAGMRFGKCMAGKCHC | 4266 |
| GVIINVKCKISRQCL[hLys]PCKDAGMRFGKCMAGKCHC | 4267 |
| GVIINVKCKISRQCL[hArg]PCKDAGMRFGKCMAGKCHC | 4268 |
| GVIINVKCKISRQCL[Cit]PCKDAGMRFGKCMAGKCHC | 4269 |
| GVIINVKCKISRQCL[hCit]PCKDAGMRFGKCMAGKCHC | 4270 |
| GVIINVKCKISRQCL[Dpr]PCKDAGMRFGKCMAGKCHC | 4271 |
| GVIINVKCKISRQCL[Dab]PCKDAGMRFGKCMAGKCHC | 4272 |
| GVIINVKCKISRQCLOPCKDAGMRFGKCMAGKCAC | 4273 |
| GVIINVKCKISRQCL[hLys]PCKDAGMRFGKCMAGKCAC | 4274 |
| GVIINVKCKISRQCL[hArg]PCKDAGMRFGKCMAGKCAC | 4275 |
| GVIINVKCKISRQCL[Cit]PCKDAGMRFGKCMAGKCAC | 4276 |
| GVIINVKCKISRQCL[hCit]PCKDAGMRFGKCMAGKCHC | 4277 |
| GVIINVKCKISRQCL[Dpr]PCKDAGMRFGKCMAGKCAC | 4278 |
| GVIINVKCKISRQCL[Dab]PCKDAGMRFGKCMAGKCAC | 4279 |
| GVIINVKCKISRQCLKPCKDAGMRFGKCMAGKCGCYGG | 4280 |
| GVIINVKCKISRQCLOPCKDAGMRFGKCMAGKCHCYGG | 4281 |
| GVIINVKCKISRQCL[hLys]PCKDAGMRFGKCMAGKCHCYGG | 4282 |
| GVIINVKCKISRQCL[hArg]PCKDAGMRFGKCMAGKCHCYGG | 4283 |
| GVIINVKCKISRQCL[Cit]PCKDAGMRFGKCMAGKCHCYGG | 4284 |
| GVIINVKCKISRQCL[hCit]PCKDAGMRFGKCMAGKCHCYGG | 4285 |
| GVIINVKCKISRQCL[Dpr]PCKDAGMRFGKCMAGKCHCYGG | 4286 |
| GVIINVKCKISRQCLKPCKDAGMRFGKCMAGKCACYGG | 4287 |
| GVIINVKCKISRQCLOPCKDAGMRFGKCMAGKCACYGG | 4288 |
| GVIINVKCKISRQCL[hLys]PCKDAGMRFGKCMAGKCACYGG | 4289 |
| GVIINVKCKISRQCL[hArg]PCKDAGMRFGKCMAGKCACYGG | 4290 |
| GVIINVKCKISRQCL[Cit]PCKDAGMRFGKCMAGKCACYGG | 4291 |
| GVIINVKCKISRQCL[hCit]PCKDAGMRFGKCMAGKCHCYGG | 4292 |
| GVIINVKCKISRQCL[Dpr]PCKDAGMRFGKCMAGKCACYGG | 4293 |
| GVIINVKCKISRQCL[Dab]PCKDAGMRFGKCMAGKCACYGG | 4294 |
| GVIINVKCKISRQCLKPCKDAGMRFGKCMAGKCACYG | 4295 |
| GVIINVKCKISRQCLOPCKDAGMRFGKCMAGKCHCGGG | 4296 |
| GVIINVKCKISRQCL[hLys]PCKDAGMRFGKCMAGKCHCGGG | 4297 |
| GVIINVKCKISRQCL[hArg]PCKDAGMRFGKCMAGKCHCGGG | 4298 |
| GVIINVKCKISRQCL[Cit]PCKDAGMRFGKCMAGKCHCGGG | 4299 |
| GVIINVKCKISRQCL[hCit]PCKDAGMRFGKCMAGKCHCGGG | 4300 |
| GVIINVKCKISRQCL[Dpr]PCKDAGMRFGKCMAGKCHCGGG | 4301 |
| GVIINVKCKISRQCLKPCKDAGMRFGKCMAGKCACFGG | 4302 |
| GVIINVKCKISRQCLOPCKDAGMRFGKCMAGKCACGGG | 4303 |
| GVIINVKCKISRQCL[hLys]PCKDAGMRFGKCMAGKCACGGG | 4304 |
| GVIINVKCKISRQCL[hArg]PCKDAGMRFGKCMAGKCACGGG | 4305 |
| GVIINVKCKISRQCL[Cit]PCKDAGMRFGKCMAGKCACGGG | 4306 |
| GVIINVKCKISRQCL[hCit]PCKDAGMRFGKCMAGKCACGGG | 4307 |
| GVIINVKCKISRQCL[Dpr]PCKDAGMRFGKCMAGKCACGGG | 4308 |
| GVIINVKCKISRQCL[Dab]PCKDAGMRFGKCMAGKCACGGG | 4309 |
| GVIINVKCKISRQCLKPCKDAGMRFGKCMAGKCACGG | 4310 |
| GVIINVKCKISRQCLKPCKDAGMRFGKCMAGKCACYG | 4311 |
| GVIINVKCKISRQCLOPCKDAGMRFGKCMAGKCACGG | 4312 |
| GVIINVKCKISRQCL[hLys]PCKEAGMRFGKCMAGKCHCTPK | 4313 |
| GVIINVKCKISRQCL[hArg]PCKEAGMRFGKCMAGKCHCTPK | 4314 |
| GVIINVKCKISRQCL[Cit]PCKEAGMRFGKCMAGKCHCTPK | 4315 |
| GVIINVKCKISRQCL[hCit]PCKEAGMRFGKCMAGKCHCTPK | 4316 |
| GVIINVKCKISRQCL[Dpr]PCKEAGMRFGKCMAGKCHCTPK | 4317 |
| GVIINVKCKISRQCL[Dab]PCKEAGMRFGKCMAGKCHCTPK | 4318 |

TABLE 7H-continued

Additional useful OSK1 peptide analogs: Ala 30 Substituted Series

| Sequence/structure | SEQ ID NO: |
|---|---|
| GVIINVKCKISRQCLOPCKEAGMRFGKCMAGKCHCYPK | 4319 |
| GVIINVKCKISRQCL[hLys]PCKEAGMRFGKCMAGKCHCYPK | 4320 |
| GVIINVKCKISRQCL[hArg]PCKEAGMRFGKCMAGKCHCYPK | 4321 |
| GVIINVKCKISRQCL[Cit]PCKEAGMRFGKCMAGKCHCYPK | 4322 |
| GVIINVKCKISRQCL[hCit]PCKEAGMRFGKCMAGKCHCYPK | 4323 |
| GVIINVKCKISRQCL[Dpr]PCKEAGMRFGKCMAGKCHCYPK | 4324 |
| GVIINVKCKISRQCL[Dab]PCKEAGMRFGKCMAGKCHCYPK | 4325 |
| GVIINVKCKISRQCLOPCKEAGMRFGKCMAGKCACTPK | 4326 |
| GVIINVKCKISRQCL[hLys]PCKEAGMRFGKCMAGKCACTPK | 4327 |
| GVIINVKCKISRQCL[hArg]PCKEAGMRFGKCMAGKCACTPK | 4328 |
| GVIINVKCKISRQCL[Cit]PCKEAGMRFGKCMAGKCACTPK | 4329 |
| GVIINVKCKISRQCL[hCit]PCKEAGMRFGKCMAGKCHCTPK | 4330 |
| GVIINVKCKISRQCL[Dpr]PCKEAGMRFGKCMAGKCACTPK | 4331 |
| GVIINVKCKISRQCL[Dab]PCKEAGMRFGKCMAGKCACTPK | 4332 |
| GVIINVKCKISRQCLOPCKEAGMRFGKCMAGKCHC | 4333 |
| GVIINVKCKISRQCL[hLys]PCKEAGMRFGKCMAGKCHC | 4334 |
| GVIINVKCKISRQCL[hArg]PCKEAGMRFGKCMAGKCHC | 4335 |
| GVIINVKCKISRQCL[Cit]PCKEAGMRFGKCMAGKCHC | 4336 |
| GVIINVKCKISRQCL[hCit]PCKEAGMRFGKCMAGKCHC | 4337 |
| GVIINVKCKISRQCL[Dpr]PCKEAGMRFGKCMAGKCHC | 4338 |
| GVIINVKCKISRQCLOPCKEAGMRFGKCMAGKCAC | 4339 |
| GVIINVKCKISRQCL[hLys]PCKEAGMRFGKCMAGKCAC | 4340 |
| GVIINVKCKISRQCL[hArg]PCKEAGMRFGKCMAGKCAC | 4341 |
| GVIINVKCKISRQCL[Cit]PCKEAGMRFGKCMAGKCAC | 4342 |
| GVIINVKCKISRQCL[hCit]PCKEAGMRFGKCMAGKCHC | 4343 |
| GVIINVKCKISRQCL[Dpr]PCKEAGMRFGKCMAGKCAC | 4344 |
| GVIINVKCKISRQCL[Dab]PCKEAGMRFGKCMAGKCAC | 4345 |
| GVIINVKCKISRQCLKPCKEAGMRFGKCMAGKCHCYGG | 4346 |
| GVIINVKCKISRQCLOPCKEAGMRFGKCMAGKCHCYGG | 4347 |
| GVIINVKCKISRQCLKPCKEAGMRFGKCMAGKCHCYG | 4348 |
| GVIINVKCKISRQCLKPCKEAGMRFGKCMAGKCACYG | 4349 |
| GVIINVKCKISRQCL[hLys]PCKEAGMRFGKCMAGKCHCYGG | 4350 |
| GVIINVKCKISRQCL[hArg]PCKEAGMRFGKCMAGKCHCYGG | 4351 |
| GVIINVKCKISRQCL[Cit]PCKEAGMRFGKCMAGKCHCYGG | 4352 |
| GVIINVKCKISRQCL[hCit]PCKEAGMRFGKCMAGKCHCYGG | 4353 |
| GVIINVKCKISRQCL[Dpr]PCKEAGMRFGKCMAGKCHCYGG | 4354 |
| GVIINVKCKISRQCL[Dab]PCKEAGMRFGKCMAGKCHCYGG | 4355 |
| GVIINVKCKISRQCLKPCKEAGMRFGKCMAGKCACYG | 4356 |
| GVIINVKCKISRQCLOPCKEAGMRFGKCMAGKCACYGG | 4357 |
| GVIINVKCKISRQCL[hLys]PCKEAGMRFGKCMAGKCACYGG | 4358 |
| GVIINVKCKISRQCL[hArg]PCKEAGMRFGKCMAGKCACYGG | 4359 |
| GVIINVKCKISRQCL[Cit]PCKEAGMRFGKCMAGKCACYGG | 4360 |
| GVIINVKCKISRQCL[hCit]PCKEAGMRFGKCMAGKCHCYGG | 4361 |
| GVIINVKCKISRQCL[Dpr]PCKEAGMRFGKCMAGKCACYGG | 4362 |
| GVIINVKCKISRQCL[Dab]PCKEAGMRFGKCMAGKCACYGG | 4363 |
| GVIINVKCKISRQCLKPCKEAGMRFGKCMAGKCACFGG | 4364 |
| GVIINVKCKISRQCLOPCKEAGMRFGKCMAGKCHCGGG | 4365 |
| GVIINVKCKISRQCL[hLys]PCKEAGMRFGKCMAGKCHCGGG | 4366 |
| GVIINVKCKISRQCL[hArg]PCKEAGMRFGKCMAGKCHCGGG | 4367 |
| GVIINVKCKISRQCL[Cit]PCKEAGMRFGKCMAGKCHCGGG | 4368 |
| GVIINVKCKISRQCL[hCit]PCKEAGMRFGKCMAGKCHCGGG | 4369 |
| GVIINVKCKISRQCL[Dpr]PCKEAGMRFGKCMAGKCHCGGG | 4370 |
| GVIINVKCKISRQCLOPCKEAGMRFGKCMAGKCACGGG | 4371 |
| GVIINVKCKISRQCL[hLys]PCKEAGMRFGKCMAGKCACGGG | 4372 |
| GVIINVKCKISRQCL[hArg]PCKEAGMRFGKCMAGKCACGGG | 4373 |
| GVIINVKCKISRQCL[Cit]PCKEAGMRFGKCMAGKCACGGG | 4374 |
| GVIINVKCKISRQCL[hCit]PCKEAGMRFGKCMAGKCACTP | 4375 |
| GVIINVKCKISRQCL[Dpr]PCKEAGMRFGKCMAGKCACTP | 4376 |
| GVIINVKCKISRQCL[Dab]PCKEAGMRFGKCMAGKCACTP | 4377 |
| GVIINVKCKISRQCLOPCKDAGMRFGKCMAGKCHCTPK-amide | 4378 |
| GVIINVKCKISRQCL[hLys]PCKDAGMRFGKCMAGKCHCTPK-amide | 4379 |
| GVIINVKCKISRQCL[hArg]PCKDAGMRFGKCMAGKCHCTPK-amide | 4380 |
| GVIINVKCKISRQCL[Cit]PCKDAGMRFGKCMAGKCHCTPK-amide | 4381 |
| GVIINVKCKISRQCL[hCit]PCKDAGMRFGKCMAGKCHCTPK-amide | 4382 |
| GVIINVKCKISRQCL[Dpr]PCKDAGMRFGKCMAGKCHCTPK-amide | 4383 |
| GVIINVKCKISRQCL[Dab]PCKDAGMRFGKCMAGKCHCTPK-amide | 4384 |
| GVIINVKCKISRQCLOPCKDAGMRFGKCMAGKCHCYPK-amide | 4385 |
| GVIINVKCKISRQCL[hLys]PCKDAGMRFGKCMAGKCHCYPK-amide | 4386 |

TABLE 7H-continued

Additional useful OSK1 peptide analogs: Ala 30 Substituted Series

| Sequence/structure | SEQ ID NO: |
|---|---|
| GVIINVKCKISRQCL[hArg]PCKDAGMRFGKCMAGKCHCYPK-amide | 4387 |
| GVIINVKCKISRQCL[Cit]PCKDAGMRFGKCMAGKCHCYPK-amide | 4388 |
| GVIINVKCKISRQCL[hCit]PCKDAGMRFGKCMAGKCHCYPK-amide | 4389 |
| GVIINVKCKISRQCL[Dpr]PCKDAGMRFGKCMAGKCHCYPK-amide | 4390 |
| GVIINVKCKISRQCL[Dab]PCKDAGMRFGKCMAGKCHCYPK-amide | 4391 |
| GVIINVKCKISRQCLOPCKDAGMRFGKCMAGKCACTPK-amide | 4392 |
| GVIINVKCKISRQCL[hLys]PCKDAGMRFGKCMAGKCACTPK-amide | 4393 |
| GVIINVKCKISRQCL[hArg]PCKDAGMRFGKCMAGKCACTPK-amide | 4394 |
| GVIINVKCKISRQCL[Cit]PCKDAGMRFGKCMAGKCACTPK-amide | 4395 |
| GVIINVKCKISRQCL[hCit]PCKDAGMRFGKCMAGKCACTPK-amide | 4396 |
| GVIINVKCKISRQCL[Dpr]PCKDAGMRFGKCMAGKCACTPK-amide | 4397 |
| GVIINVKCKISRQCL[Dab]PCKDAGMRFGKCMAGKCACTPK-amide | 4398 |
| GVIINVKCKISRQCLOPCKDAGMRFGKCMAGKCHC-amide | 4399 |
| GVIINVKCKISRQCL[hLys]PCKDAGMRFGKCMAGKCHC-amide | 4400 |
| GVIINVKCKISRQCL[hArg]PCKDAGMRFGKCMAGKCHC-amide | 4401 |
| GVIINVKCKISRQCL[Cit]PCKDAGMRFGKCMAGKCHC-amide | 4402 |
| GVIINVKCKISRQCL[hCit]PCKDAGMRFGKCMAGKCHC-amide | 4403 |
| GVIINVKCKISRQCL[Dpr]PCKDAGMRFGKCMAGKCHC-amide | 4404 |
| GVIINVKCKISRQCLOPCKDAGMRFGKCMAGKCAC-amide | 4405 |
| GVIINVKCKISRQCL[hLys]PCKDAGMRFGKCMAGKCAC-amide | 4406 |
| GVIINVKCKISRQCL[hArg]PCKDAGMRFGKCMAGKCAC-amide | 4407 |
| GVIINVKCKISRQCL[Cit]PCKDAGMRFGKCMAGKCAC-amide | 4408 |
| GVIINVKCKISRQCL[hCit]PCKDAGMRFGKCMAGKCHC-amide | 4409 |
| GVIINVKCKISRQCL[Dpr]PCKDAGMRFGKCMAGKCAC-amide | 4410 |
| GVIINVKCKISRQCL[Dab]PCKDAGMRFGKCMAGKCAC-amide | 4411 |
| GVIINVKCKISRQCLKPCKDAGMRFGKCMAGKCHCYGG-amide | 4412 |
| GVIINVKCKISRQCLOPCKDAGMRFGKCMAGKCHCYGG-amide | 4413 |

TABLE 7H-continued

Additional useful OSK1 peptide analogs: Ala 30 Substituted Series

| Sequence/structure | SEQ ID NO: |
|---|---|
| GVIINVKCKISRQCL[hLys]PCKDAGMRFGKCMAGKCHCYGG-amide | 4414 |
| GVIINVKCKISRQCL[hArg]PCKDAGMRFGKCMAGKCHCYGG-amide | 4415 |
| GVIINVKCKISRQCL[Cit]PCKDAGMRFGKCMAGKCHCYGG-amide | 4416 |
| GVIINVKCKISRQCL[hCit]PCKDAGMRFGKCMAGKCHCYGG-amide | 4417 |
| GVIINVKCKISRQCL[Dpr]PCKDAGMRFGKCMAGKCHCYGG-amide | 4418 |
| GVIINVKCKISRQCLKPCKDAGMRFGKCMAGKCHCFGG-amide | 4419 |
| GVIINVKCKISRQCLKPCKDAGMRFGKCMAGKCHCYG-amide | 4420 |
| GVIINVKCKISRQCLKPCKDAGMRFGKCMAGKCACYG-amide | 4421 |
| GVIINVKCKISRQCLOPCKDAGMRFGKCMAGKCACYGG-amide | 4422 |
| GVIINVKCKISRQCL[hLys]PCKDAGMRFGKCMAGKCACYGG-amide | 4423 |
| GVIINVKCKISRQCL[hArg]PCKDAGMRFGKCMAGKCACYGG-amide | 4424 |
| GVIINVKCKISRQCL[Cit]PCKDAGMRFGKCMAGKCACYGG-amide | 4425 |
| GVIINVKCKISRQCL[hCit]PCKDAGMRFGKCMAGKCACYGG-amide | 4426 |
| GVIINVKCKISRQCL[Dpr]PCKDAGMRFGKCMAGKCACYGG-amide | 4427 |
| GVIINVKCKISRQCL[Dab]PCKDAGMRFGKCMAGKCACYGG-amide | 4428 |
| GVIINVKCKISRQCLKPCKDAGMRFGKCMAGKCACYGG-amide | 4429 |
| GVIINVKCKISRQCLOPCKDAGMRFGKCMAGKCHCGGG-amide | 4430 |
| GVIINVKCKISRQCL[hLys]PCKDAGMRFGKCMAGKCHCGGG-amide | 4431 |
| GVIINVKCKISRQCL[hArg]PCKDAGMRFGKCMAGKCHCGGG-amide | 4432 |
| GVIINVKCKISRQCL[Cit]PCKDAGMRFGKCMAGKCHCGGG-amide | 4433 |
| GVIINVKCKISRQCL[hCit]PCKDAGMRFGKCMAGKCHCGGG-amide | 4434 |
| GVIINVKCKISRQCL[Dpr]PCKDAGMRFGKCMAGKCHCGGG-amide | 4435 |
| GVIINVKCKISRQCLKPCKDAGMRFGKCMAGKCACGGG-amide | 4436 |
| GVIINVKCKISRQCLOPCKDAGMRFGKCMAGKCACFGG-amide | 4437 |
| GVIINVKCKISRQCLOPCKDAGMRFGKCMAGKCACGGG-amide | 4438 |
| GVIINVKCKISRQCL[hLys]PCKDAGMRFGKCMAGKCACGGG-amide | 4439 |
| GVIINVKCKISRQCL[hArg]PCKDAGMRFGKCMAGKCACGGG-amide | 4440 |

TABLE 7H-continued

| Additional useful OSK1 peptide analogs: Ala 30 Substituted Series | |
|---|---|
| Sequence/structure | SEQ ID NO: |
| GVIINVKCKISRQCL[Cit]PCKDAGMRFGKCMAGKCACGGG-amide | 4441 |
| GVIINVKCKISRQCL[hCit]PCKDAGMRFGKCMAGKCACGGG-amide | 4442 |
| GVIINVKCKISRQCL[Dpr]PCKDAGMRFGKCMAGKCACGGG-amide | 4443 |
| GVIINVKCKISRQCL[Dab]PCKDAGMRFGKCMAGKCACGGG-amide | 4444 |
| GVIINVKCKISRQCLOPCKEAGMRFGKCMAGKCHCTPK-amide | 4445 |
| GVIINVKCKISRQCL[hLys]PCKEAGMRFGKCMAGKCHCTPK-amide | 4446 |
| GVIINVKCKISRQCL[hArg]PCKEAGMRFGKCMAGKCHCTPK-amide | 4447 |
| GVIINVKCKISRQCL[Cit]PCKEAGMRFGKCMAGKCHCTPK-amide | 4448 |
| GVIINVKCKISRQCL[hCit]PCKEAGMRFGKCMAGKCHCTPK-amide | 4449 |
| GVIINVKCKISRQCL[Dpr]PCKEAGMRFGKCMAGKCHCTPK-amide | 4450 |
| GVIINVKCKISRQCL[Dab]PCKEAGMRFGKCMAGKCHCTPK-amide | 4451 |
| GVIINVKCKISRQCLOPCKEAGMRFGKCMAGKCHCYPK-amide | 4452 |
| GVIINVKCKISRQCL[hLys]PCKEAGMRFGKCMAGKCHCYPK-amide | 4453 |
| GVIINVKCKISRQCL[hArg]PCKEAGMRFGKCMAGKCHCYPK-amide | 4454 |
| GVIINVKCKISRQCL[Cit]PCKEAGMRFGKCMAGKCHCYPK-amide | 4455 |
| GVIINVKCKISRQCL[hCit]PCKEAGMRFGKCMAGKCHCYPK-amide | 4456 |
| GVIINVKCKISRQCL[Dpr]PCKEAGMRFGKCMAGKCHCYPK-amide | 4457 |
| GVIINVKCKISRQCL[Dab]PCKEAGMRFGKCMAGKCHCYPK-amide | 4458 |
| GVIINVKCKISRQCLOPCKEAGMRFGKCMAGKCACTPK-amide | 4459 |
| GVIINVKCKISRQCL[hLys]PCKEAGMRFGKCMAGKCACTPK-amide | 4460 |
| GVIINVKCKISRQCL[hArg]PCKEAGMRFGKCMAGKCACTPK-amide | 4461 |
| GVIINVKCKISRQCL[Cit]PCKEAGMRFGKCMAGKCACTPK-amide | 4462 |
| GVIINVKCKISRQCL[hCit]PCKEAGMRFGKCMAGKCACTPK-amide | 4463 |
| GVIINVKCKISRQCL[Dpr]PCKEAGMRFGKCMAGKCACTPK-amide | 4464 |
| GVIINVKCKISRQCL[Dab]PCKEAGMRFGKCMAGKCACTPK-amide | 4465 |

TABLE 7H-continued

| Additional useful OSK1 peptide analogs: Ala 30 Substituted Series | |
|---|---|
| Sequence/structure | SEQ ID NO: |
| GVIINVKCKISRQCLOPCKEAGMRFGKCMAGKCHC-amide | 4466 |
| GVIINVKCKISRQCL[hLys]PCKEAGMRFGKCMAGKCHC-amide | 4467 |
| GVIINVKCKISRQCL[hArg]PCKEAGMRFGKCMAGKCHC-amide | 4468 |
| GVIINVKCKISRQCL[Cit]PCKEAGMRFGKCMAGKCHC-amide | 4469 |
| GVIINVKCKISRQCL[hCit]PCKEAGMRFGKCMAGKCHC-amide | 4470 |
| GVIINVKCKISRQCL[Dpr]PCKEAGMRFGKCMAGKCHC-amide | 4471 |
| GVIINVKCKISRQCLOPCKEAGMRFGKCMAGKCAC-amide | 4472 |
| GVIINVKCKISRQCL[hLys]PCKEAGMRFGKCMAGKCAC-amide | 4473 |
| GVIINVKCKISRQCL[hArg]PCKEAGMRFGKCMAGKCAC-amide | 4474 |
| GVIINVKCKISRQCL[Cit]PCKEAGMRFGKCMAGKCAC-amide | 4475 |
| GVIINVKCKISRQCL[hCit]PCKEAGMRFGKCMAGKCHC-amide | 4476 |
| GVIINVKCKISRQCL[Dpr]PCKEAGMRFGKCMAGKCAC-amide | 4477 |
| GVIINVKCKISRQCL[Dab]PCKEAGMRFGKCMAGKCAC-amide | 4478 |
| GVIINVKCKISRQCLKPCKEAGMRFGKCMAGKCHCWGG-amide | 4479 |
| GVIINVKCKISRQCLOPCKEAGMRFGKCMAGKCHCYGG-amide | 4480 |
| GVIINVKCKISRQCL[hLys]PCKEAGMRFGKCMAGKCHCYGG-amide | 4481 |
| GVIINVKCKISRQCL[hArg]PCKEAGMRFGKCMAGKCHCYGG-amide | 4482 |
| GVIINVKCKISRQCL[Cit]PCKEAGMRFGKCMAGKCHCYGG-amide | 4483 |
| GVIINVKCKISRQCL[hCit]PCKEAGMRFGKCMAGKCHCYGG-amide | 4484 |
| GVIINVKCKISRQCL[Dpr]PCKEAGMRFGKCMAGKCHCYGG-amide | 4485 |
| GVIINVKCKISRQCL[Dab]PCKEAGMRFGKCMAGKCHCYGG-amide | 4486 |
| GVIINVKCKISRQCLKPCKEAGMRFGKCMAGKCACYGG-amide | 4487 |
| GVIINVKCKISRQCLOPCKEAGMRFGKCMAGKCACYGG-amide | 4488 |
| GVIINVKCKISRQCL[hLys]PCKEAGMRFGKCMAGKCACYGG-amide | 4489 |
| GVIINVKCKISRQCL[hArg]PCKEAGMRFGKCMAGKCACYGG-amide | 4490 |
| GVIINVKCKISRQCL[Cit]PCKEAGMRFGKCMAGKCACYGG-amide | 4491 |
| GVIINVKCKISRQCL[hCit]PCKEAGMRFGKCMAGKCHCYGG-amide | 4492 |
| GVIINVKCKISRQCL[Dpr]PCKEAGMRFGKCMAGKCACYGG-amide | 4493 |

TABLE 7H-continued

Additional useful OSK1 peptide analogs: Ala 30 Substituted Series

| Sequence/structure | SEQ ID NO: |
|---|---|
| GVIINVKCKISRQCL[Dab]PCKEAGMRFGKCMAGKCACYGG-amide | 4494 |
| GVIINVKCKISRQCLOPCKEAGMRFGKCMAGKCHCGGG-amide | 4495 |
| GVIINVKCKISRQCL[hLys]PCKEAGMRFGKCMAGKCHCGGG-amide | 4496 |
| GVIINVKCKISRQCL[hArg]PCKEAGMRFGKCMAGKCHCGGG-amide | 4497 |
| GVIINVKCKISRQCL[Cit]PCKEAGMRFGKCMAGKCHCGGG-amide | 4498 |
| GVIINVKCKISRQCL[hCit]PCKEAGMRFGKCMAGKCHCGGG-amide | 4499 |
| GVIINVKCKISRQCL[Dpr]PCKEAGMRFGKCMAGKCHCGGG-amide | 4500 |
| GVIINVKCKISRQCLOPCKEAGMRFGKCMAGKCACGGG-amide | 4501 |
| GVIINVKCKISRQCL[hLys]PCKEAGMRFGKCMAGKCACGGG-amide | 4502 |
| GVIINVKCKISRQCL[hArg]PCKEAGMRFGKCMAGKCACGGG-amide | 4503 |
| GVIINVKCKISRQCL[Cit]PCKEAGMRFGKCMAGKCACGGG-amide | 4504 |
| GVIINVKCKISRQCL[hCit]PCKEAGMRFGKCMAGKCACTP-amide | 4505 |
| GVIINVKCKISRQCL[Dpr]PCKEAGMRFGKCMAGKCACGGG-amide | 4506 |
| GVIINVKCKISRQCL[Dab]PCKEAGMRFGKCMAGKCACGGG-amide | 4507 |
| GVIINVKCKISRQCLKPCK[Cpa]AGMRFGKCMAGKCACYGG-amide | 4508 |
| GVIINVKCKISRQCLKPCK[Cpa]AGMRFGKCMAGKCACGGG-amide | 4509 |
| GVIINVKCKISRQCLKPCK[Cpa]AGMRFGKCMAGKCACY-amide | 4510 |
| Ac-GVIINVKCKISRQCLKPCKDAGMRFGKCMAGKCACYGG-amide | 4511 |
| GVIINVKCKISRQCLKPCK[Aad]AGMRFGKCMAGKCACYGG-amide | 4512 |
| GVIINVKCKISRQCLKPCK[Aad]AGMRFGKCMAGKCHCYGG-amide | 4513 |
| GVIINVKCKISRQCLKPCK[Aad]AGMRFGKCMAGKCACYGG | 4514 |
| GVIINVKCKISRQCLHPCKDAGMRFGKCMAGKCACYGG-amide | 4515 |
| GVIINVKCKISRQCLHPCKDAGMRFGKCMAGKCACYGG | 4516 |
| GVIINVKCKISRQCLHPCKDAGMRFGKCMAGKCACY-amide | 4517 |
| GVIINVKCKISRQCLHPCKDAGMRFGKCMAGKCHCYGG-amide | 4518 |
| GVIINVKCKISRQCLHPCKDAGMRFGKCMAGKCHCYGG | 4519 |
| GVIINVKCKISRQCLHPCKDAGMRFGKCMAGKCHCYPK | 4520 |
| GVIINVKCKISRQCLHPCKDAGMRFGKCMAGKCAC | 4521 |
| GVIINVKCKISRQCLKPCKDAGMRFGKCMAGKCAC[1Nal]GG-amide | 4522 |
| GVIINVKCKISRQCLKPCKDAGMRFGKCMAGKCAC[1Nal]PK-amide | 4523 |
| GVIINVKCKISRQCLKPCKDAGMRFGKCMAGKCAC[2Nal]GG-amide | 4524 |
| GVIINVKCKISRQCLKPCKDAGMRFGKCMAGKCAC[Cha]GG-amide | 4525 |
| GVIINVKCKISRQCLKPCKDAGMRFGKCMAGKCAC[MePhe]GG-amide | 4526 |
| GVIINVKCKISRQCLKPCKDAGMRFGKCMAGKCAC[BiPhA]GG-amide | 4527 |
| GVIINVKCKISRQCLKPCKDAGMRFGKCMAGKC[Aib]CYGG-amide | 4528 |
| GVIINVKCKISRQCLKPCKDAGMRFGKCMAGKC[Abu]CYGG-amide | 4529 |
| GVIINVKCKISRQCLKPCKDAGMRFGKCMAGKCAC[1Nal] | 4530 |
| GVIINVKCKISRQCLHPCKDAGMRFGKCMAGKCAC[1Nal]GG-amide | 4531 |
| GVIINVKCKISRQCLKPCKDAGMRFGKCMAGKCAC[4Bip]-amide | 4532 |
| GVIINVKCKISRQCLHPCKDAGMRFGKCMAGKCAC[4Bip]GG-amide | 4533 |
| GVIINVKCKISRQCLKPCKDAGMRFGKCMAGKCHCGGG | 4534 |

TABLE 7I

Additional useful OSK1 peptide analogs: Combined Ala-11, 12, 27, 29, 30 Substituted Series

| Sequence/structure | SEQ ID NO: |
|---|---|
| GVIINVKCKIAAQCLEPCKKAGMRFGACAAGKCHCTPK | 4535 |
| GVIINVSCKIAAQCLEPCKKAGMRFGACAAGKCHCTPK | 4536 |
| GVIINVKCKIAAQCLKPCKKAGMRFGACAAGKCHCTPK | 4537 |
| GVIINVKCKIAAQCLEPCKDAGMRFGACAAGKCHCTPK | 4538 |
| GVIINVKCKIAAQCLKPCKDAGMRFGACAAGKCHCTPK | 4539 |
| GVIINVSCKIAAQCLKPCKDAGMRFGACAAGKCHCTPK | 4540 |
| GVIINVKCKISPQCLKPCKDAGMRFGACAAGKCHCTPK | 4541 |
| GVIINVKCKIAAQCLKPCKDAGMRFGACAAGKCHCYPK | 4542 |
| Ac-GVIINVKCKISPQCLKPCKDAGMRFGACAAGKCHCTPK | 4543 |
| GVIINVKCKISPQCLKPCKDAGMRFGACAAGKCHCTPK-amide | 4544 |

TABLE 7I-continued

Additional useful OSK1 peptide analogs: Combined Ala-11, 12, 27, 29, 30 Substituted Series

| Sequence/structure | SEQ ID NO: |
|---|---|
| Ac-GVIINVKCKISPQCLKPCKDAGMRFGACAAGKCHCTPK-amide | 4545 |
| GVIINVKCKIAAQCLKPCKDAGMRFGACAAGKCHCYPK-amide | 4546 |
| Ac-GVIINVKCKIAAQCLKPCKDAGMRFGACAAGKCHCYPK | 4547 |
| Ac-GVIINVKCKIAAQCLKPCKDAGMRFGACAAGKCHCYPK-amide | 4548 |
| GVIINVKCKIAAQCLKPCKKAGMRFGACAAGKCHCTPK-amide | 4549 |
| Ac-GVIINVKCKIAAQCLKPCKKAGMRFGACAAGKCHCTPK | 4550 |
| Ac-GVIINVKCKIAAQCLKPCKKAGMRFGACAAGKCHCTPK-amide | 4551 |
| Ac-GVIINVKCKIAAQCLEPCKDAGMRFGACAAGKCHCTPK | 4552 |
| GVIINVKCKIAAQCLEPCKDAGMRFGACAAGKCHCTPK-amide | 4553 |
| Ac-GVIINVKCKIAAQCLEPCKDAGMRFGACAAGKCHCTPK-amide | 4554 |
| GVIINVKCKIAAQCLEPCKKAGMRFGACAAGKCHCTPK-amide | 4555 |
| Ac-GVIINVKCKIAAQCLEPCKKAGMRFGACAAGKCHCTPK | 4556 |
| Ac-GVIINVKCKIAAQCLEPCKKAGMRFGACAAGKCHCTPK-amide | 4557 |
| GVIINVKCKIAAQCLKPCKDAGMRFGACAAGKCHCTPK-amide | 4558 |
| Ac-GVIINVKCKIAAQCLKPCKDAGMRFGACAAGKCHCTPK | 4559 |
| Ac-GVIINVKCKIAAQCLKPCKDAGMRFGACAAGKCHCTPK-amide | 4560 |
| VIINVKCKIAAQCLEPCKKAGMRFGACAAGKCHCTPK | 4561 |
| Ac-VIINVKCKIAAQCLEPCKKAGMRFGACAAGKCHCTPK | 4562 |
| VIINVKCKIAAQCLEPCKKAGMRFGACAAGKCHCTPK-amide | 4563 |
| Ac-VIINVKCKIAAQCLEPCKKAGMRFGACAAGKCHCTPK-amide | 4564 |
| GVIINVKCKIAAQCLEPCKKAGMRFGACAAGKCACTPK | 4565 |
| Ac-GVIINVKCKIAAQCLEPCKKAGMRFGACAAGKCACTPK | 4566 |
| GVIINVKCKIAAQCLEPCKKAGMRFGACAAGKCACTPK-amide | 4567 |
| Ac-GVIINVKCKIAAQCLEPCKKAGMRFGACAAGKCACTPK-amide | 4568 |
| VIINVKCKIAAQCLKPCKDAGMRFGACAAGKCHCTPK | 4569 |
| Ac-VIINVKCKIAAQCLKPCKDAGMRFGACAAGKCHCTPK | 4570 |
| VIINVKCKIAAQCLKPCKDAGMRFGACAAGKCHCTPK-amide | 4571 |
| Ac-VIINVKCKIAAQCLKPCKDAGMRFGACAAGKCHCTPK-amide | 4572 |
| NVKCKIAAQCLKPCKDAGMRFGACAAGKCHCTPK | 4573 |
| Ac-NVKCKIAAQCLKPCKDAGMRFGACAAGKCHCTPK | 4574 |
| NVKCKIAAQCLKPCKDAGMRFGACAAGKCHCTPK-amide | 4575 |
| Ac-NVKCKIAAQCLKPCKDAGMRFGACAAGKCHCTPK-amide | 4576 |
| KCKIAAQCLKPCKDAGMRFGACAAGKCHCTPK | 4577 |
| Ac-KCKIAAQCLKPCKDAGMRFGACAAGKCHCTPK | 4578 |
| KCKIAAQCLKPCKDAGMRFGACAAGKCHCTPK-amide | 4579 |
| Ac-KCKIAAQCLKPCKDAGMRFGACAAGKCHCTPK-amide | 4580 |
| CKIAAQCLKPCKDAGMRFGACAAGKCHCTPK | 4581 |
| Ac-CKIAAQCLKPCKDAGMRFGACAAGKCHCTPK | 4582 |
| CKIAAQCLKPCKDAGMRFGACAAGKCHCTPK-amide | 4583 |
| Ac-CKIAAQCLKPCKDAGMRFGACAAGKCHCTPK-amide | 4584 |
| GVIINVKCKIAAQCLKPCKDAGMRNGACAAGKCHCTPK | 4585 |
| GVIINVKCKIAAQCLKPCKDAGMRNGACAAGKCHCTPK-amide | 4586 |
| Ac-GVIINVKCKIAAQCLKPCKDAGMRNGACAAGKCHCTPK | 4587 |
| Ac-GVIINVKCKIAAQCLKPCKDAGMRNGACAAGKCHCTPK-amide | 4588 |
| GVIINVKCKIAAQCLKPCKDAGMRFGKCMNRKCHCTPK | 4589 |
| GVIINVKCKIAAQCLKPCKDAGMRFGKCMNRKCHCTPK-amide | 4590 |
| Ac-GVIINVKCKIAAQCLKPCKDAGMRFGKCMNRKCHCTPK | 4591 |
| Ac-GVIINVKCKIAAQCLKPCKDAGMRFGKCMNRKCHCTPK-amide | 4592 |
| GVIINVKCKISKQCLKPCRDAGMRFGACAAGKCHCTPK | 4593 |
| Ac-GVIINVKCKISKQCLKPCRDAGMRFGACAAGKCHCTPK | 4594 |
| GVIINVKCKISKQCLKPCRDAGMRFGACAAGKCHCTPK-amide | 4595 |
| Ac-GVIINVKCKISKQCLKPCRDAGMRFGACAAGKCHCTPK-amide | 4596 |
| TIINVKCKIAAQCLKPCKDAGMRFGACAAGKCHCTPK | 4597 |
| Ac-TIINVKCKIAAQCLKPCKDAGMRFGACAAGKCHCTPK | 4598 |
| TIINVKCKIAAQCLKPCKDAGMRFGACAAGKCHCTPK-amide | 4599 |
| Ac-TIINVKCKIAAQCLKPCKDAGMRFGACAAGKCHCTPK-amide | 4600 |
| GVKINVKCKIAAQCLEPCKKAGMRFGACAAGKCHCTPK | 4601 |
| Ac-GVKINVKCKIAAQCLEPCKKAGMRFGACAAGKCHCTPK | 4602 |
| GVKINVKCKIAAQCLEPCKKAGMRFGACAAGKCHCTPK-amide | 4603 |
| Ac-GVKINVKCKIAAQCLEPCKKAGMRFGACAAGKCHCTPK-amide | 4604 |
| GVKINVKCKIAAQCLEPCKKAGMRFGACAAGKCACTPK | 4605 |
| GVKINVKCKIAAQCLKPCKDAGMRFGACAAGKCHCTPK | 4606 |
| GVKINVKCKIAAQCLKPCKDAGMRFGACAAGKCACTPK | 4607 |
| Ac-GVKINVKCKIAAQCLEPCKKAGMRFGACAAGKCACTPK | 4608 |

TABLE 7I-continued

Additional useful OSK1 peptide analogs: Combined Ala-11, 12, 27, 29, 30 Substituted Series

| Sequence/structure | SEQ ID NO: |
|---|---|
| GVKINVKCKIAAQCLEPCKKAGMRFGACAAGKCACTPK-amide | 4609 |
| Ac-GVKINVKCKIAAQCLEPCKKAGMRFGACAAGKCACTPK-amide | 4610 |
| Ac-GVKINVKCKIAAQCLKPCKDAGMRFGACAAGKCACTPK | 4611 |
| GVKINVKCKIAAQCLKPCKDAGMRFGACAAGKCACTPK-amide | 4612 |
| Ac-GVKINVKCKIAAQCLKPCKDAGMRFGACAAGKCACTPK-amide | 4613 |
| Ac-GVKINVKCKIAAQCLKPCKDAGMRFGACAAGKCHCTPK | 4614 |
| GVKINVKCKIAAQCLKPCKDAGMRFGACAAGKCHCTPK-amide | 4615 |
| Ac-GVKINVKCKIAAQCLKPCKDAGMRFGACAAGKCHCTPK-amide | 4616 |
| GVIINVKCKIAAQCLKPCKDAGMRFGACAAGKCHCT | 4617 |
| GVIINVKCKIAAQCLOPCKDAGMRFGACAAGKCHCTPK | 4618 |
| GVIINVKCKIAAQCL[hLys]PCKDAGMRFGACAAGKCHCTPK | 4619 |
| GVIINVKCKIAAQCL[hArg]PCKDAGMRFGACAAGKCHCTPK | 4620 |
| GVIINVKCKIAAQCL[Cit]PCKDAGMRFGACAAGKCHCTPK | 4621 |
| GVIINVKCKIAAQCL[hCit]PCKDAGMRFGACAAGKCHCTPK | 4622 |
| GVIINVKCKIAAQCL[Dpr]PCKDAGMRFGACAAGKCHCTPK | 4623 |
| GVIINVKCKIAAQCL[Dab]PCKDAGMRFGACAAGKCHCTPK | 4624 |
| GVIINVKCKIAAQCLOPCKDAGMRFGACAAGKCHCYPK | 4625 |
| GVIINVKCKIAAQCL[hLys]PCKDAGMRFGACAAGKCHCYPK | 4626 |
| GVIINVKCKIAAQCL[hArg]PCKDAGMRFGACAAGKCHCYPK | 4627 |
| GVIINVKCKIAAQCL[Cit]PCKDAGMRFGACAAGKCHCYPK | 4628 |
| GVIINVKCKIAAQCL[hCit]PCKDAGMRFGACAAGKCHCYPK | 4629 |
| GVIINVKCKIAAQCL[Dpr]PCKDAGMRFGACAAGKCHCYPK | 4630 |
| GVIINVKCKIAAQCL[Dab]PCKDAGMRFGACAAGKCHCYPK | 4631 |
| GVIINVKCKIAAQCLKPCKDAGMRFGACAAGKCACYPK | 4632 |
| GVIINVKCKIAAQCLKPCKDAGMRFGACAAGKCGCYPK | 4633 |
| GVIINVKCKIAAQCLKPCKDAGMRFGACAAGKCACFPK | 4634 |
| GVIINVKCKIAAQCLKPCKDAGMRFGACAAGKCACWPK | 4635 |
| GVIINVKCKIAAQCLKPCKEAGMRFGACAAGKCACYPK | 4636 |
| GVIINVKCKIAAQCLOPCKDAGMRFGACAAGKCACTPK | 4637 |
| GVIINVKCKIAAQCL[hLys]PCKDAGMRFGACAAGKCACTPK | 4638 |
| GVIINVKCKIAAQCL[hArg]PCKDAGMRFGACAAGKCACTPK | 4639 |
| GVIINVKCKIAAQCL[Cit]PCKDAGMRFGACAAGKCACTPK | 4640 |
| GVIINVKCKIAAQCL[hCit]PCKDAGMRFGACAAGKCHCTPK | 4641 |
| GVIINVKCKIAAQCL[Dpr]PCKDAGMRFGACAAGKCACTPK | 4642 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[Dab]PCKDAGMRFGACAAGKCACTPK | 4643 |
| GVIINVKCKIAAQCLOPCKDAGMRFGACAAGKCHC | 4644 |
| GVIINVKCKIAAQCL[hLys]PCKDAGMRFGACAAGKCHC | 4645 |
| GVIINVKCKIAAQCL[hArg]PCKDAGMRFGACAAGKCHC | 4646 |
| GVIINVKCKIAAQCL[Cit]PCKDAGMRFGACAAGKCHC | 4647 |
| GVIINVKCKIAAQCL[hCit]PCKDAGMRFGACAAGKCHC | 4648 |
| GVIINVKCKIAAQCL[Dpr]PCKDAGMRFGACAAGKCHC | 4649 |
| GVIINVKCKIAAQCL[Dab]PCKDAGMRFGACAAGKCHC | 4650 |
| GVIINVKCKIAAQCLOPCKDAGMRFGACAAGKCAC | 4651 |
| GVIINVKCKIAAQCL[hLys]PCKDAGMRFGACAAGKCAC | 4652 |
| GVIINVKCKIAAQCL[hArg]PCKDAGMRFGACAAGKCAC | 4653 |
| GVIINVKCKIAAQCL[Cit]PCKDAGMRFGACAAGKCAC | 4654 |
| GVIINVKCKIAAQCL[hCit]PCKDAGMRFGACAAGKCHC | 4655 |
| GVIINVKCKIAAQCL[Dpr]PCKDAGMRFGACAAGKCAC | 4656 |
| GVIINVKCKIAAQCL[Dab]PCKDAGMRFGACAAGKCAC | 4657 |
| GVIINVKCKIAAQCLKPCKDAGMRFGACAAGKCGCYGG | 4658 |
| GVIINVKCKIAAQCLOPCKDAGMRFGACAAGKCHCYGG | 4659 |
| GVIINVKCKIAAQCL[hLys]PCKDAGMRFGACAAGKCHCYGG | 4660 |
| GVIINVKCKIAAQCL[hArg]PCKDAGMRFGACAAGKCHCYGG | 4661 |
| GVIINVKCKIAAQCL[Cit]PCKDAGMRFGACAAGKCHCYGG | 4662 |
| GVIINVKCKIAAQCL[hCit]PCKDAGMRFGACAAGKCHCYGG | 4663 |
| GVIINVKCKIAAQCL[Dpr]PCKDAGMRFGACAAGKCHCYGG | 4664 |
| GVIINVKCKIAAQCLKPCKDAGMRFGACAAGKCACYGG | 4665 |
| GVIINVKCKIAAQCLOPCKDAGMRFGACAAGKCACYGG | 4666 |
| GVIINVKCKIAAQCL[hLys]PCKDAGMRFGACAAGKCACYGG | 4667 |
| GVIINVKCKIAAQCL[hArg]PCKDAGMRFGACAAGKCACYGG | 4668 |
| GVIINVKCKIAAQCL[Cit]PCKDAGMRFGACAAGKCACYGG | 4669 |
| GVIINVKCKIAAQCL[hCit]PCKDAGMRFGACAAGKCHCYGG | 4670 |
| GVIINVKCKIAAQCL[Dpr]PCKDAGMRFGACAAGKCACYGG | 4671 |
| GVIINVKCKIAAQCL[Dab]PCKDAGMRFGACAAGKCACYGG | 4672 |
| GVIINVKCKIAAQCLKPCKDAGMRFGACAAGKCACYG | 4673 |
| GVIINVKCKIAAQCLOPCKDAGMRFGACAAGKCHCGGG | 4674 |
| GVIINVKCKIAAQCL[hLys]PCKDAGMRFGACAAGKCHCGGG | 4675 |
| GVIINVKCKIAAQCL[hArg]PCKDAGMRFGACAAGKCHCGGG | 4676 |
| GVIINVKCKIAAQCL[Cit]PCKDAGMRFGACAAGKCHCGGG | 4677 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[hCit]PCKDAGMRFGACAAGKCHCGGG | 4678 |
| GVIINVKCKIAAQCL[Dpr]PCKDAGMRFGACAAGKCHCGGG | 4679 |
| GVIINVKCKIAAQCLKPCKDAGMRFGACAAGKCACFGG | 4680 |
| GVIINVKCKIAAQCLOPCKDAGMRPGACAAGKCACGGG | 4681 |
| GVIINVKCKIAAQCL[hLys]PCKDAGMRFGACAAGKCACGGG | 4682 |
| GVIINVKCKIAAQCL[hArg]PCKDAGMRFGACAAGKCACGGG | 4683 |
| GVIINVKCKIAAQCL[Cit]PCKDAGMRFGACAAGKCACGGG | 4684 |
| GVIINVKCKIAAQCL[hCit]PCKDAGMRFGACAAGKCACGGG | 4685 |
| GVIINVKCKIAAQCL[Dpr]PCKDAGMRFGACAAGKCACGGG | 4686 |
| GVIINVKCKIAAQCL[Dab]PCKDAGMRFGACAAGKCACGGG | 4687 |
| GVIINVKCKIAAQCLKPCKDAGMRFGACAAGKCACGG | 4688 |
| GVIINVKCKIAAQCLKPCKDAGMRFGACAAGKCACYG | 4689 |
| GVIINVKCKIAAQCLOPCKDAGMRFGACAAGKCACGG | 4690 |
| GVIINVKCKIAAQCL[hLys]PCKEAGMRFGACAAGKCHCTPK | 4691 |
| GVIINVKCKIAAQCL[hArg]PCKEAGMRFGACAAGKCHCTPK | 4692 |
| GVIINVKCKIAAQCL[Cit]PCKEAGMRFGACAAGKCHCTPK | 4693 |
| GVIINVKCKIAAQCL[hCit]PCKEAGMRFGACAAGKCHCTPK | 4694 |
| GVIINVKCKIAAQCL[Dpr]PCKEAGMRFGACAAGKCHCTPK | 4695 |
| GVIINVKCKIAAQCL[Dab]PCKEAGMRFGACAAGKCHCTPK | 4696 |
| GVIINVKCKIAAQCLOPCKEAGMRFGACAAGKCHCYPK | 4697 |
| GVIINVKCKIAAQCL[hLys]PCKEAGMRFGACAAGKCHCYPK | 4698 |
| GVIINVKCKIAAQCL[hArg]PCKEAGMRFGACAAGKCHCYPK | 4699 |
| GVIINVKCKIAAQCL[Cit]PCKEAGMRFGACAAGKCHCYPK | 4700 |
| GVIINVKCKIAAQCL[hCit]PCKEAGMRFGACAAGKCHCYPK | 4701 |
| GVIINVKCKIAAQCL[Dpr]PCKEAGMRFGACAAGKCHCYPK | 4702 |
| GVIINVKCKIAAQCL[Dab]PCKEAGMRFGACAAGKCHCYPK | 4703 |
| GVIINVKCKIAAQCLOPCKEAGMRFGACAAGKCACTPK | 4704 |
| GVIINVKCKIAAQCL[hLys]PCKEAGMRFGACAAGKCACTPK | 4705 |
| GVIINVKCKIAAQCL[hArg]PCKEAGMRFGACAAGKCACTPK | 4706 |
| GVIINVKCKIAAQCL[Cit]PCKEAGMRFGACAAGKCACTPK | 4707 |
| GVIINVKCKIAAQCL[hCit]PCKEAGMRFGACAAGKCHCTPK | 4708 |
| GVIINVKCKIAAQCL[Dpr]PCKEAGMRFGACAAGKCACTPK | 4709 |
| GVIINVKCKIAAQCL[Dab]PCKEAGMRFGACAAGKCACTPK | 4710 |
| GVIINVKCKIAAQCLOPCKEAGMRFGACAAGKCHC | 4711 |
| GVIINVKCKIAAQCL[hLys]PCKEAGMRFGACAAGKCHC | 4712 |
| GVIINVKCKIAAQCL[hArg]PCKEAGMRFGACAAGKCHC | 4713 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[Cit]PCKEAGMRFGACAAGKCHC | 4714 |
| GVIINVKCKIAAQCL[hCit]PCKEAGMRFGACAAGKCHC | 4715 |
| GVIINVKCKIAAQCL[Dpr]PCKEAGMRFGACAAGKCHC | 4716 |
| GVIINVKCKIAAQCLOPCKEAGMRFGACAAGKCAC | 4717 |
| GVIINVKCKIAAQCL[hLys]PCKEAGMRFGACAAGKCAC | 4718 |
| GVIINVKCKIAAQCL[hArg]PCKEAGMRFGACAAGKCAC | 4719 |
| GVIINVKCKIAAQCL[Cit]PCKEAGMRFGACAAGKCAC | 4720 |
| GVIINVKCKIAAQCL[hCit]PCKEAGMRFGACAAGKCHC | 4721 |
| GVIINVKCKIAAQCL[Dpr]PCKEAGMRFGACAAGKCAC | 4722 |
| GVIINVKCKIAAQCL[Dab]PCKEAGMRFGACAAGKCAC | 4723 |
| GVIINVKCKIAAQCLKPCKEAGMRFGACAAGKCHCYGG | 4724 |
| GVIINVKCKIAAQCLOPCKEAGMRFGACAAGKCHCYGG | 4725 |
| GVIINVKCKIAAQCLKPCKEAGMRFGACAAGKCHCYG | 4726 |
| GVIINVKCKIAAQCLKPCKEAGMRFGACAAGKCACYG | 4727 |
| GVIINVKCKIAAQCL[hLys]PCKEAGMRFGACAAGKCHCYGG | 4728 |
| GVIINVKCKIAAQCL[hArg]PCKEAGMRFGACAAGKCHCYGG | 4729 |
| GVIINVKCKIAAQCL[Cit]PCKEAGMRFGACAAGKCHCYGG | 4730 |
| GVIINVKCKIAAQCL[hCit]PCKEAGMRFGACAAGKCHCYGG | 4731 |
| GVIINVKCKIAAQCL[Dpr]PCKEAGMRFGACAAGKCHCYGG | 4732 |
| GVIINVKCKIAAQCL[Dab]PCKEAGMRFGACAAGKCHCYGG | 4733 |
| GVIINVKCKIAAQCLKPCKEAGMRFGACAAGKCACYG | 4734 |
| GVIINVKCKIAAQCLOPCKEAGMRFGACAAGKCACYGG | 4735 |
| GVIINVKCKIAAQCL[hLys]PCKEAGMRFGACAAGKCACYGG | 4736 |
| GVIINVKCKIAAQCL[hArg]PCKEAGMRFGACAAGKCACYGG | 4737 |
| GVIINVKCKIAAQCL[Cit]PCKEAGMRFGACAAGKCACYGG | 4738 |
| GVIINVKCKIAAQCL[hCit]PCKEAGMRFGACAAGKCHCYGG | 4739 |
| GVIINVKCKIAAQCL[Dpr]PCKEAGMRFGACAAGKCACYGG | 4740 |
| GVIINVKCKIAAQCL[Dab]PCKEAGMRPGACAAGKCACYGG | 4741 |
| GVIINVKCKIAAQCLKPCKEAGMRFGACAAGKCACFGG | 4742 |
| GVIINVKCKIAAQCLOPCKEAGMRFGACAAGKCHCGGG | 4743 |
| GVIINVKCKIAAQCL[hLys]PCKEAGMRFGACAAGKCHCGGG | 4744 |
| GVIINVKCKIAAQCL[hArg]PCKEAGMRFGACAAGKCHCGGG | 4745 |
| GVIINVKCKIAAQCL[Cit]PCKEAGMRFGACAAGKCHCGGG | 4746 |
| GVIINVKCKIAAQCL[hCit]PCKEAGMRFGACAAGKCHCGGG | 4747 |
| GVIINVKCKIAAQCL[Dpr]PCKEAGMRFGACAAGKCHCGGG | 4748 |

TABLE 7I-continued

| Additional useful OSK1 peptide analogs: Combined Ala-11, 12, 27, 29, 30 Substituted Series | |
|---|---|
| Sequence/structure | SEQ ID NO: |
| GVIINVKCKIAAQCLOPCKEAGMRFGACAAGKCACGGG | 4749 |
| GVIINVKCKIAAQCL[hLys]PCKEAGMRFGACAAGKCACGGG | 4750 |
| GVIINVKCKIAAQCL[hArg]PCKEAGMRFGACAAGKCACGGG | 4751 |
| GVIINVKCKIAAQCL[Cit]PCKEAGMRFGACAAGKCACGGG | 4752 |
| GVIINVKCKIAAQCL[hCit]PCKEAGMRFGACAAGKCACTP | 4753 |
| GVIINVKCKIAAQCL[Dpr]PCKEAGMRFGACAAGKCACTP | 4754 |
| GVIINVKCKIAAQCL[Dab]PCKEAGMRFGACAAGKCACTP | 4755 |
| GVIINVKCKIAAQCLOPCKDAGMRFGACAAGKCHCTPK-amide | 4756 |
| GVIINVKCKIAAQCL[hLys]PCKDAGMRFGACAAGKCHCTPK-amide | 4757 |
| GVIINVKCKIAAQCL[hArg]PCKDAGMRFGACAAGKCHCTPK-amide | 4758 |
| GVIINVKCKIAAQCL[Cit]PCKDAGMRFGACAAGKCHCTPK-amide | 4759 |
| GVIINVKCKIAAQCL[hCit]PCKDAGMRFGACAAGKCHCTPK-amide | 4760 |
| GVIINVKCKIAAQCL[Dpr]PCKDAGMRFGACAAGKCHCTPK-amide | 4761 |
| GVIINVKCKIAAQCL[Dab]PCKDAGMRFGACAAGKCHCTPK-amide | 4762 |
| GVIINVKCKIAAQCLOPCKDAGMRFGACAAGKCHCYPK-amide | 4763 |
| GVIINVKCKIAAQCL[hLys]PCKDAGMRFGACAAGKCHCYPK-amide | 4764 |
| GVIINVKCKIAAQCL[hArg]PCKDAGMRFGACAAGKCHCYPK-amide | 4765 |
| GVIINVKCKIAAQCL[Cit]PCKDAGMRFGACAAGKCHCYPK-amide | 4766 |
| GVIINVKCKIAAQCL[hCit]PCKDAGMRFGACAAGKCHCYPK-amide | 4767 |
| GVIINVKCKIAAQCL[Dpr]PCKDAGMRFGACAAGKCHCYPK-amide | 4768 |
| GVIINVKCKIAAQCL[Dab]PCKDAGMRFGACAAGKCHCYPK-amide | 4769 |
| GVIINVKCKIAAQCLOPCKDAGMRFGACAAGKCACTPK-amide | 4770 |
| GVIINVKCKIAAQCL[hLys]PCKDAGMRFGACAAGKCACTPK-amide | 4771 |
| GVIINVKCKIAAQCL[hArg]PCKDAGMRFGACAAGKCACTPK-amide | 4772 |
| GVIINVKCKIAAQCL[Cit]PCKDAGMRFGACAAGKCACTPK-amide | 4773 |
| GVIINVKCKIAAQCL[hCit]PCKDAGMRFGACAAGKCACTPK-amide | 4774 |
| GVIINVKCKIAAQCL[Dpr]PCKDAGMRFGACAAGKCACTPK-amide | 4775 |
| GVIINVKCKIAAQCL[Dab]PCKDAGMRFGACAAGKCACTPK-amide | 4776 |
| GVIINVKCKIAAQCLOPCKDAGMRFGACAAGKCHC-amide | 4777 |
| GVIINVKCKIAAQCL[hLys]PCKDAGMRFGACAAGKCHC-amide | 4778 |
| GVIINVKCKIAAQCL[hArg]PCKDAGMRFGACAAGKCHC-amide | 4779 |
| GVIINVKCKIAAQCL[Cit]PCKDAGMRFGACAAGKCHC-amide | 4780 |
| GVIINVKCKIAAQCL[hCit]PCKDAGMRFGACAAGKCHC-amide | 4781 |
| GVIINVKCKIAAQCL[Dpr]PCKDAGMRFGACAAGKCHC-amide | 4782 |
| GVIINVKCKIAAQCLOPCKDAGMRFGACAAGKCAC-amide | 4783 |
| GVIINVKCKIAAQCL[hLys]PCKDAGMRFGACAAGKCAC-amide | 4784 |
| GVIINVKCKIAAQCL[hArg]PCKDAGMRFGACAAGKCAC-amide | 4785 |
| GVIINVKCKIAAQCL[Cit]PCKDAGMRFGACAAGKCAC-amide | 4786 |
| GVIINVKCKIAAQCL[hCit]PCKDAGMRFGACAAGKCHC-amide | 4787 |
| GVIINVKCKIAAQCL[Dpr]PCKDAGMRFGACAAGKCAC-amide | 4788 |
| GVIINVKCKIAAQCL[Dab]PCKDAGMRFGACAAGKCAC-amide | 4789 |
| GVIINVKCKIAAQCLKPCKDAGMRFGACAAGKCHCYGG-amide | 4790 |
| GVIINVKCKIAAQCLOPCKDAGMRFGACAAGKCHCYCG-amide | 4791 |
| GVIINVKCKIAAQCL[hLys]PCKDAGMRFGACAAGKCHCYGG-amide | 4792 |
| GVIINVKCKIAAQCL[hArg]PCKDAGMRFGACAAGKCHCYGG-amide | 4793 |
| GVIINVKCKIAAQCL[Cit]PCKDAGMRFGACAAGKCHCYGG-amide | 4794 |
| GVIINVKCKIAAQCL[hCit]PCKDAGMRFGACAAGKCHCYGG-amide | 4795 |
| GVIINVKCKIAAQCL[Dpr]PCKDAGMRFGACAAGKCHCYGG-amide | 4796 |
| GVIINVKCKIAAQCLKPCKDAGMRFGACAAGKCHCFGG-amide | 4797 |
| GVIINVKCKIAAQCLKPCKDAGMRFGACAAGKCHCYG-amide | 4798 |
| GVIINVKCKIAAQCLKPCKDAGMRFGACAAGKCACYG-amide | 4799 |
| GVIINVKCKIAAQCLOPCKDAGMRFGACAAGKCACYGG-amide | 4800 |
| GVIINVKCKIAAQCL[hLys]PCKDAGMRFGACAAGKCACYGG-amide | 4801 |
| GVIINVKCKIAAQCL[hArg]PCKDAGMRFGACAAGKCACYGG-amide | 4802 |
| GVIINVKCKIAAQCL[Cit]PCKDAGMRFGACAAGKCACYGG-amide | 4803 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[hCit]PCKDAGMRFGACAAGKCACYGG-amide | 4804 |
| GVIINVKCKIAAQCL[Dpr]PCKDAGMRFGACAAGKCACYGG-amide | 4805 |
| GVIINVKCKIAAQCL[Dab]PCKDAGMRFGACAAGKCACYGG-amide | 4806 |
| GVIINVKCKIAAQCLKPCKDAGMRFGACAAGKCACYGG-amide | 4807 |
| GVIINVKCKIAAQCLOPCKDAGMRFGACAAGKCHCGGG-amide | 4808 |
| GVIINVKCKIAAQCL[hLys]PCKDAGMRFGACAAGKCHCGGG-amide | 4809 |
| GVIINVKCKIAAQCL[hArg]PCKDAGMRFGACAAGKCHCGGG-amide | 4810 |
| GVIINVKCKIAAQCL[Cit]PCKDAGMRFGACAAGKCHCGGG-amide | 4811 |
| GVIINVKCKIAAQCL[hCit]PCKDAGMRFGACAAGKCHCGGG-amide | 4812 |
| GVIINVKCKIAAQCL[Dpr]PCKDAGMRFGACAAGKCHCGGG-amide | 4813 |
| GVIINVKCKIAAQCLKPCKDAGMRFGACAAGKCACGGG-amide | 4814 |
| GVIINVKCKIAAQCLOPCKDAGMRFGACAAGKCACGGG-amide | 4815 |
| GVIINVKCKIAAQCLOPCKDAGMRFGACAAGKCACGGG-amide | 4816 |
| GVIINVKCKIAAQCL[hLys]PCKDAGMRFGACAAGKCACGGG-amide | 4817 |
| GVIINVKCKIAAQCL[hArg]PCKDAGMRFGACAAGKCACGGG-amide | 4818 |
| GVIINVKCKIAAQCL[Cit]PCKDAGMRFGACAAGKCACGGG-amide | 4819 |
| GVIINVKCKIAAQCL[hCit]PCKDAGMRFGACAAGKCACGGG-amide | 4820 |
| GVIINVKCKIAAQCL[Dpr]PCKDAGMRFGACAAGKCACGGG-amide | 4821 |
| GVIINVKCKIAAQCL[Dab]PCKDAGMRFGACAAGKCACGGG-amide | 4822 |
| GVIINVKCKIAAQCLOPCKEAGMRFGACAAGKCHCTPK-amide | 4823 |
| GVIINVKCKIAAQCL[hLys]PCKEAGMRFGACAAGKCHCTPK-amide | 4824 |
| GVIINVKCKIAAQCL[hArg]PCKEAGMRFGACAAGKCHCTPK-amide | 4825 |
| GVIINVKCKIAAQCL[Cit]PCKEAGMRFGACAAGKCHCTPK-amide | 4826 |
| GVIINVKCKIAAQCL[hCit]PCKEAGMRFGACAAGKCHCTPK-amide | 4827 |
| GVIINVKCKIAAQCL[Dpr]PCKEAGMRFGACAAGKCHCTPK-amide | 4828 |
| GVIINVKCKIAAQCL[Dab]PCKEAGMRFGACAAGKCHCTPK-amide | 4829 |
| GVIINVKCKIAAQCLOPCKEAGMRFGACAAGKCHCYPK-amide | 4830 |
| GVIINVKCKIAAQCL[hLys]PCKEAGMRFGACAAGKCHCYPK-amide | 4831 |
| GVIINVKCKIAAQCL[hArg]PCKEAGMRFGACAAGKCHCYPK-amide | 4832 |
| GVIINVKCKIAAQCL[Cit]PCKEAGMRFGACAAGKCHCYPK-amide | 4833 |
| GVIINVKCKIAAQCL[hCit]PCKEAGMRFGACAAGKCHCYPK-amide | 4834 |
| GVIINVKCKIAAQCL[Dpr]PCKEAGMRFGACAAGKCHCYPK-amide | 4835 |
| GVIINVKCKIAAQCL[Dab]PCKEAGMRFGACAAGKCHCYPK-amide | 4836 |
| GVIINVKCKIAAQCLOPCKEAGMRFGACAAGKCACTPK-amide | 4837 |
| GVIINVKCKIAAQCL[hLys]PCKEAGMRFGACAAGKCACTPK-amide | 4838 |
| GVIINVKCKIAAQCL[hArg]PCKEAGMRFGACAAGKCACTPK-amide | 4839 |
| GVIINVKCKIAAQCL[Cit]PCKEAGMRFGACAAGKCACTPK-amide | 4840 |
| GVIINVKCKIAAQCL[hCit]PCKEAGMRFGACAAGKCACTPK-amide | 4841 |
| GVIINVKCKIAAQCL[Dpr]PCKEAGMRFGACAAGKCACTPK-amide | 4842 |
| GVIINVKCKIAAQCL[Dab]PCKEAGMRFGACAAGKCACTPK-amide | 4843 |
| GVIINVKCKIAAQCLOPCKEAGMRFGACAAGKCHC-amide | 4844 |
| GVIINVKCKIAAQCL[hLys]PCKEAGMRFGACAAGKCHC-amide | 4845 |
| GVIINVKCKIAAQCL[hArg]PCKEAGMRFGACAAGKCHC-amide | 4846 |
| GVIINVKCKIAAQCL[Cit]PCKEAGMRFGACAAGKCHC-amide | 4847 |
| GVIINVKCKIAAQCL[hCit]PCKEAGMRFGACAAGKCHC-amide | 4848 |
| GVIINVKCKIAAQCL[Dpr]PCKEAGMRFGACAAGKCHC-amide | 4849 |
| GVIINVKCKIAAQCLOPCKEAGMRFGACAAGKCAC-amide | 4850 |
| GVIINVKCKIAAQCL[hLys]PCKEAGMRFGACAAGKCAC-amide | 4851 |
| GVIINVKCKIAAQCL[hArg]PCKEAGMRFGACAAGKCAC-amide | 4852 |
| GVIINVKCKIAAQCL[Cit]PCKEAGMRFGACAAGKCAC-amide | 4853 |
| GVIINVKCKIAAQCL[hCit]PCKEAGMRFGACAAGKCHC-amide | 4854 |
| GVIINVKCKIAAQCL[Dpr]PCKEAGMRFGACAAGKCAC-amide | 4855 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[Dab]PCKEAGMRFGACAAGKCAC-amide | 4856 |
| GVIINVKCKIAAQCLKPCKEAGMRFGACAAGKCHCWGG-amide | 4857 |
| GVIINVKCKIAAQCLOPCKEAGMRFGACAAGKCHCYGG-amide | 4858 |
| GVIINVKCKIAAQCL[hLys]PCKEAGMRFGACAAGKCHCYGG-amide | 4859 |
| GVIINVKCKIAAQCL[hArg]PCKEAGMRFGACAAGKCHCYGG-amide | 4860 |
| GVIINVKCKIAAQCL[Cit]PCKEAGMRFGACAAGKCHCYGG-amide | 4861 |
| GVIINVKCKIAAQCL[hCit]PCKEAGMRFGACAAGKCHCYGG-amide | 4862 |
| GVIINVKCKIAAQCL[Dpr]PCKEAGMRFGACAAGKCHCYGG-amide | 4863 |
| GVIINVKCKIAAQCL[Dab]PCKEAGMRFGACAAGKCHCYGG-amide | 4864 |
| GVIINVKCKIAAQCLKPCKEAGMRFGACAAGKCACYGG-amide | 4865 |
| GVIINVKCKIAAQCLOPCKEAGMRFGACAAGKCACYGG-amide | 4866 |
| GVIINVKCKIAAQCL[hLys]PCKEAGMRFGACAAGKCACYGG-amide | 4867 |
| GVIINVKCKIAAQCL[hArg]PCKEAGMRFGACAAGKCACYGG-amide | 4868 |
| GVIINVKCKIAAQCL[Cit]PCKEAGMRFGACAAGKCACYGG-amide | 4869 |
| GVIINVKCKIAAQCL[hCit]PCKEAGMRFGACAAGKCHCYGG-amide | 4870 |
| GVIINVKCKIAAQCL[Dpr]PCKEAGMRFGACAAGKCACYGG-amide | 4871 |
| GVIINVKCKIAAQCL[Dab]PCKEAGMRFGACAAGKCACYGG-amide | 4872 |
| GVIINVKCKIAAQCLOPCKEAGMRFGACAAGKCHCGGG-amide | 4873 |
| GVIINVKCKIAAQCL[hLys]PCKEAGMRFGACAAGKCHCGGG-amide | 4874 |
| GVIINVKCKIAAQCL[hArg]PCKEAGMRFGACAAGKCHCGGG-amide | 4875 |
| GVIINVKCKIAAQCL[Cit]PCKEAGMRFGACAAGKCHCGGG-amide | 4876 |
| GVIINVKCKIAAQCL[hCit]PCKEAGMRFGACAAGKCHCGGG-amide | 4877 |
| GVIINVKCKIAAQCL[Dpr]PCKEAGMRFGACAAGKCHCGGG-amide | 4878 |
| GVIINVKCKIAAQCLOPCKEAGMRFGACAAGKCACGGG-amide | 4879 |
| GVIINVKCKIAAQCL[hLys]PCKEAGMRFGACAAGKCACGGG-amide | 4880 |
| GVIINVKCKIAAQCL[hArg]PCKEAGMRFGACAAGKCACGGG-amide | 4881 |

TABLE 7I-continued

Additional useful OSK1 peptide analogs: Combined Ala-11, 12, 27, 29, 30 Substituted Series

| Sequence/structure | SEQ ID NO: |
|---|---|
| GVIINVKCKIAAQCL[Cit]PCKEAGMRFGACAAGKCACGGG-amide | 4882 |
| GVIINVKCKIAAQCL[hCit]PCKEAGMRFGACAAGKCACTP-amide | 4883 |
| GVIINVKCKIAAQCL[Dpr]PCKEAGMRFGACAAGKCACGGG-amide | 4884 |
| GVIINVKCKIAAQCL[Dab]PCKEAGMRFGACAAGKCACGGG-amide | 4885 |
| GVIINVKCKIAAQCLKPCK[Cpa]AGMRFGACAAGKCACYGG-amide | 4886 |
| GVIINVKCKIAAQCLKPCK[Cpa]AGMRFGACAAGKCACGGG-amide | 4887 |
| GVIINVKCKIAAQCLKPCK[Cpa]AGMRFGACAAGKCACY-amide | 4888 |
| Ac-GVIINVKCKIAAQCLKPCKDAGMRFGACAAGKCACYGG-amide | 4889 |
| GVIINVKCKIAAQCLKPCK[Aad]AGMRFGACAAGKCACYGG-amide | 4890 |
| GVIINVKCKIAAQCLKPCK[Aad]AGMRFGACAAGKCHCYGG-amide | 4891 |
| GVIINVKCKIAAQCLKPCK[Aad]AGMRFGACAAGKCACYGG | 4892 |
| GVIINVKCKIAAQCLHPCKDAGMRFGACAAGKCACYGG-amide | 4893 |
| GVIINVKCKIAAQCLHPCKDAGMRFGACAAGKCACYGG | 4894 |
| GVIINVKCKIAAQCLHPCKDAGMRFGACAAGKCACY-amide | 4895 |
| GVIINVKCKIAAQCLHPCKDAGMRFGACAAGKCHCYGG-amide | 4896 |
| GVIINVKCKIAAQCLHPCKDAGMRFGACAAGKCHCYGG | 4897 |
| GVIINVKCKIAAQCLHPCKDAGMRFGACAAGKCHCYPK | 4898 |
| GVIINVKCKIAAQCLHPCKDAGMRFGACAAGKCAC | 4899 |
| GVIINVKCKIAAQCLKPCKDAGMRFGACAAGKCAC[1Nal]GG-amide | 4900 |
| GVIINVKCKIAAQCLKPCKDAGMRFGACAAGKCAC[1Nal]PK-amide | 4901 |
| GVIINVKCKIAAQCLKPCKDAGMRFGACAAGKCAC[2Nal]GG-amide | 4902 |
| GVIINVKCKIAAQCLKPCKDAGMRFGACAAGKCAC[Cha]GG-amide | 4903 |
| GVIINVKCKIAAQCLKPCKDAGMRFGACAAGKCAC[MePhe]GG-amide | 4904 |
| GVIINVKCKIAAQCLKPCKDAGMRFGACAAGKCAC[BiPhA]GG-amide | 4905 |
| GVIINVKCKIAAQCLKPCKDAGMRFGACAAGKC[Aib]CYGG-amide | 4906 |
| GVIINVKCKIAAQCLKPCKDAGMRFGACAAGKC[Abu]CYGG-amide | 4907 |
| GVIINVKCKIAAQCLKPCKDAGMRFGACAAGKCAC[1Nal] | 4908 |

TABLE 7I-continued

| Additional useful OSK1 peptide analogs: Combined Ala-11, 12, 27, 29, 30 Substituted Series | |
|---|---|
| Sequence/structure | SEQ ID NO: |
| GVIINVKCKIAAQCLHPCKDAGMRFGACAAGKCAC[1Nal]GG-amide | 4909 |
| GVIINVKCKIAAQCLKPCKDAGMRFGACAAGKCAC[4Bip]-amide | 4910 |
| GVIINVKCKIAAQCLHPCKDAGMRFGACAAGKCAC[4Bip]GG-amide | 4911 |
| GVIINVKCKIAAQCLKPCKDAGMRFGACAAGKCHCGGG | 4912 |
| GIINVKCKISAQCLKPCRDAGMRFGKCMNGKCACTPK | 4916 |

TABLE 7J

| Additional useful OSK1 peptide analogs | | |
|---|---|---|
| Sequence/Structure | Short-hand designation | SEQ ID NO: |
| GVIINVKCKISRQCLEPCKKAGMRFGKCMNGKC**G**CTPK | [Gly34] OSK1 | 4930 |
| GVIINVKCKISRQCLEPCKKAGMRFGKCMNGKCSCTPK | [Ser34] OSK1 | 4931 |
| GVIINVKCKISRQCLEPCKKAGMRFGKCMNGKCTCTPK | [Thr34] OSK1 | 4932 |
| GVIINVKCKISRQCLEPCKKAGMRFGKCMNGKCNCTPK | [Asn34] OSK1 | 4933 |
| GVIINVKCKISRQCLEPCKKAGMRFGKCMNGKCVCTPK | [Val34] OSK1 | 4934 |
| GVIINVKCKISRQCLEPCKKAGMRFGKCMNGKCLCTPK | [Leu34] OSK1 | 4935 |
| GVIINVKCKISRQCLEPCKKAGMRFGKCMNGKCICTPK | [Ile34] OSK1 | 4936 |
| GVIINVKCKISRQCLEPCKKAGMRFGKCMNGKCPCTPK | [Pro34] OSK1 | 4937 |
| GVIINVKCKISRQCLEPCKKAGMRFGKCMNGKCMCTPK | [Met34] OSK1 | 4938 |
| GVIINVKCKISRQCLEPCKKAGMRFGKCMNGKCQCTPK | [Gln34] OSK1 | 4939 |
| GVIINVKCKISRQCLEPCKKAGMRFGKCMNGKCKCTPK | [Lys34] OSK1 | 4940 |
| GVIINVKCKISRQCLEPCKKAGMRFGKCMNGKCDCTPK | [Asp34] OSK1 | 4941 |
| WVIINVKCKISRQCLEPCKKAGMRFGKCMNGKCHCWPK | [Trp1] OSK1 | 4942 |
| GV**W**INVKCKISRQCLEPCKKAGMRFGKCMNGKCHCTPK | [Trp3] OSK1 | 4943 |
| GVII**W**VKCKISRQCLEPCKKAGMRFGKCMNGKCHCTPK | [Trp5] OSK1 | 4944 |

TABLE 7J-continued

| Additional useful OSK1 peptide analogs | | |
|---|---|---|
| Sequence/Structure | Short-hand designation | SEQ ID NO: |
| [**1Nal**]VIINVKCKISRQCLEPCKKAGMRFGKCMNGKCHCWPK | [1Nal1] OSk1 | 4945 |
| GV[**1Nal**]INVKCKISRQCLEPCKKAGMRFGKCMNGKCHCTPK | [1Nal3] OSK1 | 4946 |
| GVII[**1Nal**]VKCKISRQCLEPCKKAGMRFGKCMNGKCHCTPK | [1Nal5] OSK1 | 4947 |
| GVI**K**NVKCKISRQCLEPCKKAGMRFGKCMNGKCHCTPK | [Lys4] OSK1 | 4948 |
| GVI**K**NVKCKISRQCLEPCKKAGMRFGKCMNGKC**A**CTPK | [Lys4, Ala34] OSK1 | 4949 |
| [1Nal]VIINVKCKISRQCLEPCKKAGMRFGKCMNGKC**A**CWPK | [1Nal1; Ala34] OSK1 | 4950 |
| GV[**1Nal**]INVKCKISRQCLEPCKKAGMRFGKCMNGKC**A**CTPK | [1Nal3; Ala34] OSK1 | 4951 |
| GVII[**1Nal**]VKCKISRQCLEPCKKAGMRFGKCMNGKC**A**CTPK | [1Nal5; Ala34] OSK1 | 4952 |
| **W**VIINVKCKISRQCLEPCKKAGMRFGKCMNGKC**A**CWPK | [Trp1; Ala34] OSK1 | 4953 |
| GVWINVKCKISRQCLEPCKKAGMRFGKCMNGKC**A**CTPK | [Trp3; Ala34] OSK1 | 4954 |
| GVIIWVKCKISRQCLEPCKKAGMRFGKCMNGKC**A**CTPK | [Trp5; Ala34] OSK1 | 4955 |
| WV**W**I**W**VKCKISRQCLEPCKKAGMRFGKCMNGKC**A**CTPK | [Trp1,3, 5;Ala34] OSK1 | 4956 |
| [1Nal]V[**1Nal**]I[**1Nal**]VKCKISRQCLEPCKKAGMRFGKCMNGKC**A**CTPK | [1Nal1,3, 5;Ala34] OSK1 | 4957 |
| CKISRQCLEPCKKAGMRFGKCMNGKC**A**CTPK | Δ1-7, [Ala34] OSK1 | 4958 |
| KCKISRQCLEPCKKAGMRFGKCMNGKC**A**CTPK | Δ1-6, [Ala34] OSK1 | 4959 |
| GVIINVKCKI[**1Nal**]RQCLEPCKKAGMRFGKC**A**NGKCACWPK | [1Nal11; Ala29,34] Osk-1 | 4960 |
| GVIINVKCKI**R**RQCLEPCKKAGMRFGKC**A**NGKC**A**CWPK | [Arg11; Ala29,34] Osk-1 | 4961 |
| GVIINVKCKISRQCEEPCKKAGMRFGKC**A**NGKC**A**CWPK | [Glu15; Ala29,34] Osk-1 | 4962 |
| GVIINVKCKIRRQCLEPCKKAGMRFGKCMNGKC**A**CWPK | [Arg11; Ala34] Osk-1 | 4963 |

TABLE 7J-continued

Additional useful OSK1 peptide analogs

| Sequence/Structure | Short-hand designation | SEQ ID NO: |
|---|---|---|
| GVIINVKCKISRQCEEPCKKAGMRFGKCMNGKC**A** CWPK | [Glu15; Ala34] Osk-1 | 4964 |
| CKIRRQC**E**EPCKKAGMRFGKC**A**NGKC**A**CTPK | Δ1-7, [Arg11; Glu45; Ala29,34] OSK1 | 4965 |
| GVIINVKCKI**R**RQC**E**EPCKKAGMRFGKC**A**NGKC**A** CTPK | [Arg11; Glu15; Ala29,34] OSK1 | 4966 |
| CVIINVKCKI**R**RQC**E**EPCKKAGMRFGKC**A**NGKC**A** CTCK | [Cys1,37; Arg11; Glu15; Ala29,34] OSK1 | 4967 |
| GVIINVKCKI**RA**QC**E**EPCKKAGMRFGKC**A**NGKC**A** CTPK | [Arg11; Ala12,29, 34;Glu15] OSK1 | 4968 |
| GVIINVKCKIRAQC**E**EPCKKAGMRFGKC**A**NGKC**A** CTPK-NH2 | [Arg11; Glu15; Ala12,29, 34]OSK1-amide | 4969 |
| Ac-GVIINVKCKIRAQC**E**EPCKKAGMRFGKC**A**NGKC**A** CTPK-NH2 | Ac-[Arg11; Glu15; Ala12,29, 34]OSK1-amide | 4970 |
| GVIINVKCKI[1Nal]AQC**E**EPCKKAGMRFGKC**A** NGKCACTPK | [1Nal11; Glu15; Ala12,29, 34]OSK1 | 4971 |
| GVIINVKCKISRQCLEPCKKAGMRFGKC**A**NGKC [**1Nal**]CWPK | [Ala29; 1Nal34] Osk-1 | 4972 |
| GVIINVKCKIS**A**QCL**K**PCK**D**AGMRFGKCMNGKCH CTPK | [Ala12; Lys16; Asp20] Osk-1 | 4973 |
| GVIINVKCKIS**A**QCL**K**PCK**D**AGMRFGKCMNGKC**A** CTPK | [Ala12, 34;Lys16; Asp20] Osk-1 | 4974 |
| GVIINVKCKISAQCL**K**PCK**D**AGMRFGKC**A**NGKC**A** CTPK | [Ala12, 29,34; Lys16; Asp20] Osk-1 | 4975 |
| GVIINVKCKIRAQCL**K**PCK**D**AGMRFGKC**A**NGKC**A** CTPK | [Arg11; Ala12,29, 34;Lys16; Asp20] Osk-1 | 4976 |
| GVIINVKCKISAQC**EK**PCK**D**AGMRFGKC**A**NGKC**A** CTPK | [Ala12, 29,34; Glu15, Lys16; Asp20] Osk-1 | 4977 |
| GVIINVKCKI[1Nal]AQCL**K**PCK**D**AGMRFGKC**A** NGKCACTPK | [1Nal11; Ala12,29, 34;Lys16; Asp20] Osk-1 | 4978 |
| GVIINVKCKI**RA**QC**EK**PCK**D**AGMRFGKC**A**NGKC**A** CTPK | [Arg11; Ala12,29, 34;Glu15; Lys16; Asp20] Osk-1 | 4979 |
| GVIINVKCKIRAQC**EK**PCK**D**AGMRFGKCMNGKC**A** CTPK | [Arg11; Ala12,34; Glu15; Lys16; Asp20] Osk-1 | 4980 |
| GVIINVKCKISAQCLKPCKDAGMRFGKCMNGKC [1Nal]CTPK | [A12, K16, D20, Nal34]-OSK1 | 4981 |
| GVIINVKCKISAQCLKPCKDAGMRFGKCMNGKCA CTPK | [A12, K16, D20, A34]-OSK1 | 4982 |
| GVIINVKCKISAQCLKPCKDAGMRFGKCANGKC [1Nal]CTPK | [A12, K16, D20, A29, Nal34]-OSK1 | 4983 |
| GVIINVKCKISAQCLKPCKDAGMRFGKCANGKCA CTPK | [A12, K16, D20, A29, A34]-OSK1 | 4984 |
| {Acetyl}GVIINVKCKISRQCLEPCK (Glycyl)KAGMRFGKCMNGKCACTPK | Ac-[K(Gly) 19,Ala 34]-Osk1 | 4985 |
| {Acetyl}GVIK(Glycyl)NVKCKISRQCLEPC KKAGMRFGKCMNGKCACTPK | Ac-[K(Gly)4, Ala34]-Osk1 | 4986 |
| {Acetyl}GVIINVKCKISRQCLEPCKKAGMRFG KCMNGKCACTPK(Glycyl) | Ac-[Ala34,K (Gly)38]-Osk1 | 4987 |
| GVIINVKCKISRQCLEPCKKAGMRFGKCANGKC [1Nal]CTPK | [A29, Nal34]-OSK1 | 4988 |
| CKISRQCLKPCKDAGMRFGKCMNGKCHC {Amide} | OSK1 [des1-7, E16K, K20D, des36-38]-amide | 4989 |

TABLE 7J-continued

| Additional useful OSK1 peptide analogs | | |
|---|---|---|
| Sequence/Structure | Short-hand designation | SEQ ID NO: |
| GVIINVKCKISRQCLKPCKDAGMRFGKCMNGKCA CTPK | OSK1- K16, D20, A34 | 4990 |
| GVIINVKCKI[1Nal]AQCLEPCKKAGMRFGKCA NGKC[1Nal]CTPK | Osk-1 [1Nal11, A12,A29,1- Nal34] | 4991 |
| GVIINVKCKI[1Nal]AQCLEPCKKAGMRFGKCA NGKC[1Nal]CTEK | [1Nal11, A12,A29, 1Nal34, E37]Osk-1 | 4992 |
| GVIINVKCKI[1Nal]AQCEEPCKKAGMRFGKCA NGKC[1Nal]CEEK | Osk-1[1- Nal11, A12,E15 A29, 1Nal34, E36,E37] | 4993 |
| GVIINVKCKI[1Nal]AQCLEPCKKAGFRFGKCA NGKC[1Nal]CTPK | [1Nal11, A12,F23, A29, 1Nal34] Osk-1 | 4994 |
| GVIINVKCKI[1Nal]AQCLEPCKKAG[Nle]RF GKCANGKC[1Nal]CTEK | [1Nal11, A12, Nle23, A29, 1Nal34, E37]Osk-1 | 4995 |
| GVIINVKCKISPQCLKPCKDAGMRFGKCMNGKCA CTY[Nle] | [Pro12, Lys16, Asp20, Ala34, Tyr37, Nle38] Osk-1- amide | 4996 |
| GVIINVKCKISPQCLOPCKEAGMRFGKCMNGKCA CTY[Nle] | [P12, Orn16, E20,A34, Y37, Nle38] Osk-1- amide | 4997 |
| NVKCKISRQCLEPCKKAGMRFGKCANGKC [1Nal]CTPK | des1-4, [A29, Nal34]- OSK1 | 4998 |
| NVKCKISRQCLEPCKKAGMRFGKCANGKCACTPK | des1-4, [A29, A34]- OSK1 | 4999 |
| GVIINVKCKIRRQCLEPCKKAGMRFGKCANGKCA CTPK | [R11, A29, A34]- OSK1 | 5000 |
| GVIINVKCKIRAQCLEPCKKAGMRFGKCANGKCA CTPK | [R11, A12, A29, A34]- OSK1 | 5001 |

TABLE 7J-continued

| Additional useful OSK1 peptide analogs | | |
|---|---|---|
| Sequence/Structure | Short-hand designation | SEQ ID NO: |
| CKISRQCLEPCKKAGMRFGKCMNGKCACTPK | [Ala34] OSK1 (8-35) | 5002 |
| CKISRQCLEPCKKAGMRFGKCMNGKC**A**C | [Ala34] OSK1 (8-35) | 5003 |
| CKI**R**RQCLEPCKKAGMRFGKC**A**NGKC**A**C | [Arg11; Ala29,34] Osk-1 (8-35) | 5004 |
| CKIS**A**QCLEPCKKAGMRFGKC**A**NGKC**A**C | [Ala12; Ala29,34] Osk-1 (8-35) | 5005 |
| CKIS**A**QCLEPCKKAGMRFGKCMNGKC**A**C | [Ala12; Ala34] Osk-1 (8-35) | 5006 |
| GVI[**Dpr(AOA)**]NVKCKISRQCLEPCKKAGMRF GKCMNGKCHCTPK | [Dpr$^{(AoA)}$4] Osk1 | 5009 |
| GVI[**Dpr**$^{(AOA-PEG)}$]NVKCKISRQCLEPCKKA GMRFGKCMNGKCHCTPK | [Dpr$^{(AOA)-PEG)}$4]Osk1 | 5010 |
| G**C**IINVKCKISRQCLEPCKKAGMRFGKCMNGKCH T**C**K | [C2, C37]- OSK1 | 5012 |
| **SC**IINVKCKISRQCLEPCKKAGMRFGKCMNGKCH **C**TCK | [S1, C2, C37]-OSK1 | 5013 |
| **SC**IINVKCKISRQCLEPCKKAGMRFGKCMNGKC**A** **C**TCK | [S1, C2, A34, C37]- OSK1 | 5014 |
| **SCV**IINVKCKISRQCLEPCKKAGMRFGKCMNGKC HCTCK | Ser-[C1, C37]-OSK1 | 5015 |

Any OSK1 peptide analog that comprises an amino acid sequence selected from SEQ ID NOS: 1391 through 4912, 4916, 4920 through 5006, 5009, 5010, and 5012 through 5015 as set forth in Tables 7, 7A, 7B, 7C, 7D, 7E, 7F, 7G, 7H or 7I, is useful in accordance with the present invention. Any of these can also be derivatized at either its N-terminal or C-terminal, e.g., with a fatty acid having from 4 to 10 carbon atoms and from 0 to 2 carbon-carbon double bonds, or a derivative thereof such as an ω-amino-fatty acid. (E.g., Mouhat et al., WO 2006/002850 A2, which is incorporated by reference in its entirety). Examples of such fatty acids include valeric acid or (for the C-terminal) ω-amino-valeric acid.

Among useful OSK1 peptide analog sequences of the present invention are analog sequences that introduce amino acid residues that can form an intramolecular covalent bridge (e.g., a disulfide bridge) or non-covalent interactions (e.g. hydrophobic, ionic, stacking) between the first and last beta strand, which may enhance the stability of the structure of the unconjugated or conjugated (e.g., PEGylated) OSK1 peptide analog molecule. Examples of such sequences include SEQ ID NOS: 4985-4987 and 5012-5015.

In some embodiments of the composition of matter, the C-terminal carboxylic acid moiety of the OSK1 peptide analog is replaced with a moiety selected from:

(A) —COOR, where R is independently $(C_1\text{-}C_8)$alkyl, haloalkyl, aryl or heteroaryl;

(B) —C(═O)NRR, where R is independently hydrogen, $(C_1\text{-}C_8)$alkyl, haloalkyl, aryl or heteroaryl; and (C) —$CH_2$OR where R is hydrogen, $(C_1\text{-}C_8)$ alkyl, aryl or heteroaryl.

"Aryl" is phenyl or phenyl vicinally-fused with a saturated, partially-saturated, or unsaturated 3-, 4-, or 5 membered carbon bridge, the phenyl or bridge being substituted by 0, 1, 2 or 3 substituents selected from $C_{18}$ alkyl, $C_{14}$ haloalkyl or halo.

"Heteroaryl" is an unsaturated 5, 6 or 7 membered monocyclic or partially-saturated or unsaturated 6-, 7-, 8-, 9-, 10- or 11 membered bicyclic ring, wherein at least one ring is unsaturated, the monocyclic and the bicyclic rings containing 1, 2, 3 or 4 atoms selected from N, O and S, wherein the ring is substituted by 0, 1, 2 or 3 substituents selected from $C_{18}$ alkyl, $C_{14}$ haloalkyl and halo.

In other embodiments of the composition of matter comprising a half-life extending moiety, the OSK1 peptide analog comprises an amino acid sequence of the formula:

SEQ ID NO: 5011

$G^1V^2I^3I^4N^5V^6K^7C^8K^9I^{10}X_{aa}{}^{11}X_{aa}{}^{12}Q^{13}C^{14}X_{aa}{}^{15}X_{aa}{}^{16}P^{17}$ $C^{18}X_{aa}{}^{19}X_{aa}{}^{20}A^{21}G^{22}M^{23}R^{24}F^{25}G^{26}X_{aa}{}^{27}C^{28}X_{aa}{}^{29}X_{aa}{}^{30}$ $G^{31}X_{aa}{}^{32}C^{33}X_{aa}{}^{34}C^{35}X_{aa}{}^{35}X_{aa}{}^{37}X_{aa}{}^{38}$ wherein:

amino acid residues 1 through 7 are optional (Thus, the OSK1 peptide analog optionally includes residues 1-7 as indicated above in SEQ ID NO:5011, or a N-terminal truncation leaving present residues 2-7, 3-7, 4-7, 5-7, 6-7, or 7, or alternatively, a N-terminal truncation wherein all of residues 1-7 are entirely absent);

$X_{aa}{}^{11}$ is a neutral, basic, or acidic amino acid residue (e.g., Ser, Thr, Ala, Gly, Leu, Ile, Val, Met, Cit, Homocitrulline, Oic, Pro, Hyp, Tic, D-Tic, D-Pro, Guf, and 4-Amino-Phe, Thz, Aib, Sar, Pip, Bip, Phe, Tyr, Lys, His, Trp, Arg, $N^\alpha$ Methyl-Arg; homoarginine, 1-Nal, 2-Nal, Orn, D-Orn, Asn, Gln, Glu, Asp, α-aminoadipic acid, and para-carboxyl-phenylalanine);

$X_{aa}{}^{12}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}{}^{15}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}{}^{16}$ is a neutral or basic amino acid residue (e.g., Lys, His, Arg, Trp, Arg, $N^\alpha$ Methyl-Arg; homoarginine, 1-Nal, 2-Nal, Orn, D-Orn, Cit, $N^\alpha$-Methyl-Cit, Homocitrulline, His, Ala, Gly, Leu, Ile, Val, Met, Oic, Pro, Hyp, Tic, D-Tic, D-Pro, Thz, Aib, Sar, Pip, Bip, Phe, Ser, Thr, Guf, and 4-Amino-Phe);

$X_{aa}{}^{19}$ is a neutral or basic amino acid residue (e.g., Lys, His, Arg, Trp, Arg, $N^\alpha$ Methyl-Arg; homoarginine, 1-Nal, 2-Nal, Orn, D-Orn, Cit, $N^\alpha$-Methyl-Cit, Homocitrulline, His, Ala, Gly, Leu, Ile, Val, Met, Oic, Pro, Hyp, Tic, D-Tic, D-Pro, Thz, Aib, Sar, Pip, Bip, Phe, Ser, Thr, Guf, and 4-Amino-Phe);

$X_{aa}{}^{20}$ is a neutral or basic amino acid residue (e.g., Lys, His, Arg, Trp, Arg, $N^\alpha$ Methyl-Arg; homoarginine, 1-Nal, 2-Nal, Orn, D-Orn, Cit, $N^\alpha$-Methyl-Cit, Homocitruiline, His, Ala, Gly, Leu, Ile, Val, Met, Oic, Pro, Hyp, Tic, D-Tic, D-Pro, Thz, Aib, Sar, Pip, Bip, Phe, Ser, Thr, Guf, and 4-Amino-Phe);

$X_{aa}{}^{27}$ is a neutral, basic, or acidic amino acid residue (e.g., Ser, Thr, Ala, Gly, Leu, Ile, Val, Met, Cit, Homocitrulline, Oic, Pro, Hyp, Tic, D-Tic, D-Pro, Guf, and 4-Amino-Phe, Thz, Aib, Sar, Pip, Bip, Phe, Tyr, Lys, His, Trp, Arg, $N^\alpha$ Methyl-Arg; homoarginine, 1-Nal, 2-Nal, Orn, D-Orn, Asn, Gln, Glu, Asp, α-aminoadipic acid, and para-carboxyl-phenylalanine);

$X_{aa}{}^{29}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}{}^{30}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}{}^{32}$ is a neutral, basic, or acidic amino acid residue (e.g., Ser, Thr, Ala, Gly, Leu, Ile, Val, Met, Cit, Homocitrulline, Oic, Pro, Hyp, Tic, D-Tic, D-Pro, Guf, and 4-Amino-Phe, Thz, Aib, Sar, Pip, Bip, Phe, Tyr, Lys, His, Trp, Arg, $N^\alpha$ Methyl-Arg; homoarginine, 1-Nal, 2-Nal, Orn, D-Orn, Asn, Gln, Glu, Asp, α-aminoadipic acid, and para-carboxyl-phenylalanine);

$X_{aa}{}^{34}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}{}^{36}$ is optional, and if present, is a neutral amino acid residue (e.g., Pro, Ala, Gly, Leu, Ile, Val, Met, Oic, Hyp, Tic, D-Tic, D-Pro, Thz, $N^\alpha$-Methyl-Cit, Homocitrulline, Aib, Sar, Pip, Tyr, Thr, Ser, Phe, Trp, 1-Nal, 2-Nal, and Bip;

$X_{aa}{}^{37}$ is optional, and if present, is a neutral amino acid residue (e.g., Pro, Ala, Gly, Leu, Ile, Val, Met, Oic, Hyp, Tic, D-Tic, D-Pro, Thz, $N^\alpha$-Methyl-Cit, Homocitrulline, Aib, Sar, Pip, Tyr, Thr, Ser, Phe, Trp, 1-Nal, 2-Nal, and Bip); and $X_{aa}{}^{38}$ is optional, and if present, is a basic amino acid residue (e.g., Lys, His, Om, D-Orn, Arg, $N^\alpha$ Methyl-Arg; homoarginine, Cit, $N^\alpha$-Methyl-Cit, Homocitrulline, Guf, and 4-Amino-Phe).

In some other embodiments of the composition of matter comprising a half-life extending moiety, the OSK1 peptide analog comprises an amino acid sequence of the formula:

SEQ ID NO: 4913

$G^1V^2I^3I^4N^5V^6K^7C^8K^9I^{10}X_{aa}{}^{11}X_{aa}{}^{12}Q^{13}C^{14}L^{15}X_{aa}{}^{16}P^{17}$ $C^{18}K^{19}X_{aa}{}^{20}A^{21}G^{22}M^{23}R^{24}F^{25}G^{26}X_{aa}{}^{27}C^{28}X_{aa}{}^{29}X_{aa}{}^{30}G^{31}$ $K^{32}C^{33}X_{aa}{}^{34}C^{35}X_{aa}{}^{36}X_{aa}{}^{37}X_{aa}{}^{38}$ wherein:

amino acid residues 1 to 7 are optional (Thus, the OSK1 peptide analog optionally includes residues 1-7 as indicated above in SEQ ID NO:4913, or a N-terminal truncation leaving present residues 2-7, 3-7, 4-7, 5-7, 6-7, or 7, or alternatively, a N-terminal truncation wherein all of residues 1-7 are entirely absent);

$X_{aa}^{11}$ is a neutral, basic or acidic amino acid residue (e.g., Ser, Thr, Ala, Gly, Leu, Ile, Val, Met, Cit, Homocitrulline, Oic, Pro, Hyp, Tic, D-Tic, D-Pro, Guf, and 4-Amino-Phe, Thz, Aib, Sar, Pip, Bip, Phe, Tyr, Lys, His, Trp, Arg, $N^{\alpha}$ Methyl-Arg; homoarginine, 1-Nal, 2-Nal, Orn, D-Orn, Asn, Gln, Glu, Asp, α-aminoadipic acid, and para-carboxyl-phenylalanine);

$X_{aa}^{12}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}^{16}$ is a neutral or basic amino acid residue (e.g., Lys, His, Arg, Trp, Arg, $N^{\alpha}$ Methyl-Arg; homoarginine, 1-Nal, 2-Nal, Orn, D-Orn, Cit, $N^{\alpha}$-Methyl-Cit, Homocitrulline, His, Ala, Gly, Leu, Ile, Val, Met, Oic, Pro, Hyp, Tic, D-Tic, D-Pro, Thz, Aib, Sar, Pip, Bip, Phe, Ser, Thr, Guf, and 4-Amino-Phe);

$X_{aa}^{20}$ is a neutral or basic amino acid residue (e.g., Lys, His, Arg, Trp, Arg, $N^{\alpha}$ Methyl-Arg; homoarginine, 1-Nal, 2-Nal, Orn, D-Orn, Cit, $N^{\alpha}$-Methyl-Cit, Homocitrulline, His, Ala, Gly, Leu, Ile, Val, Met, Oic, Pro, Hyp, Tic, D-Tic, D-Pro, Thz, Aib, Sar, Pip, Bip, Phe, Ser, Thr, Guf, and 4-Amino-Phe);

$X_{aa}^{27}$ is a neutral, basic, or acidic amino acid residue (e.g., Ser, Thr, Ala, Gly, Leu, Ile, Val, Met, Cit, Homocitrulline, Oic, Pro, Hyp, Tic, D-Tic, D-Pro, Guf, and 4-Amino-Phe, Thz, Aib, Sar, Pip, Bip, Phe, Tyr, Lys, His, Trp, Arg, $N^{\alpha}$ Methyl-Arg; homoarginine, 1-Nal, 2-Nal, Orn, D-Orn, Asn, Gln, Glu, Asp, α-aminoadipic acid, and para-carboxyl-phenylalanine);

$X_{aa}^{29}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}^{30}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}^{34}$ is a neutral or acidic amino acid residue (e.g., Ala, Gly, Leu, Ile, Val, Met, Oic, Pro, Hyp, Tic, D-Tic, D-Pro, Thz, Aib, Sar, Pip, Bip, Phe, Tyr, Ser, Thr, Asn, Gln, Glu, Asp, α-aminoadipic acid, and para-carboxyl-phenylalanine);

$X_{aa}^{36}$ is optional, and if present, is a neutral amino acid residue (e.g., Pro, Ala, Gly, Leu, Ile, Val, Met, Oic, Hyp, Tic, D-Tic, D-Pro, Thz, $N^{\alpha}$-Methyl-Cit, Homocitrulline, Aib, Sar, Pip, Tyr, Thr, Ser, Phe, Trp, 1-Nal, 2-Nal, and Bip;

$X_{aa}^{37}$ is optional, and if present, is a neutral amino acid residue (e.g., Pro, Ala, Gly, Leu, Ile, Val, Met, Oic, Hyp, Tic, D-Tic, D-Pro, Thz, $N^{\alpha}$-Methyl-Cit, Homocitrulline, Aib, Sar, Pip, Tyr, Thr, Ser, Phe, Trp, 1-Nal, 2-Nal, and Bip); and $X_{aa}^{38}$ is optional, and if present, is a basic amino acid residue (e.g., Lys, His, Om, D-Orn, Arg, $N^{\alpha}$ Methyl-Arg; homoarginine, Cit, $N^{\alpha}$-Methyl-Cit, Homocitrulline, Guf, and 4-Amino-Phe).

TABLE 8

Pi2 peptide and PiP2 s peptide analog equences

| Sequence/structure | Short-hand designation | SEQ ID NO: |
|---|---|---|
| TISCTNPKQCYPHCKKETGYPNAKCMNRKCKCFGR | Pi2 | 17 |
| TISCTNPXQCYPHCKKETGYPNAKCMNRKCKCFGR | Pi2-X8 | 299 |
| TISCTNPAQCYPHCKKETGYPNAKCMNRKCKCFGR | Pi2-A8 | 300 |
| TISCTNPKQCYPHCXKETGYPNAKCMNRKCKCFGR | Pi2-X15 | 301 |
| TISCTNPKQCYPHCAKETGYPNAKCMNRKCKCFGR | Pi2-A15 | 302 |
| TISCTNPKQCYPHCKXETGYPNAKCMNRKCKCFGR | Pi2-X16 | 303 |
| TISCTNPKQCYPHCKAETGYPNAKCMNRKCKCFGR | Pi2-A16 | 304 |
| TISCTNPKQCYPHCKKETGYPNAXCMNRKCKCFGR | Pi2-X24 | 305 |
| TISCTNPKQCYPHCKKETGYPNAACMNRKCKCFGR | Pi2-A24 | 306 |
| TISCTNPKQCYPHCKKETGYPNAKCMNXKCKCFGR | Pi2-X28 | 307 |
| TISCTNPKQCYPHCKKETGYPNAKCMNAKCKCFGR | Pi2-A28 | 308 |
| TISCTNPKQCYPHCKKETGYPNAKCMNRXCKCFGR | Pi2-X29 | 309 |
| TISCTNPKQCYPHCKKETGYPNAKCMNRACKCFGR | Pi2-A29 | 310 |
| TISCTNPKQCYPHCKKETGYPNAKCMNRKCXCFGR | Pi2-X31 | 311 |
| TISCTNPKQCYPHCKKETGYPNAKCMNRKCACFGR | Pi2-A31 | 312 |
| TISCTNPKQCYPHCKKETGYPNAKCMNRKCKCFGX | Pi2-X35 | 313 |
| TISCTNPKQCYPHCKKETGYPNAKCMNRKCKCFGA | Pi2-A35 | 314 |
| TISCTNPKQCYPHCKKETGYPNAKCMNRKCKCFG | Pi2-d35 | 315 |

TABLE 9

Anuroctoxin (AnTx) peptide and peptide analog sequences

| Sequence/structure | Short-hand designation | SEQ ID NO: |
|---|---|---|
| ZKECTGPQHCTNFCRKNKCTHGKCMNRKCKCFNCK | Anuroctoxin (AnTx) | 62 |
| KECTGPQHCTNFCRKNKCTHGKCMNRKCKCFNCK | AnTx-d1 | 316 |
| XECTGPQHCTNFCRKNKCTHGKCMNRKCKCFNCK | AnTx-d1,X2 | 317 |
| AECTGPQHCTNFCRKNKCTHGKCMNRKCKCFNCK | AnTx-d1,A2 | 318 |

TABLE 10

Noxiustoxin (NTX) peptide and NTX peptide analog sequences

| Sequence/structure | Short-hand designation | SEQ ID NO: |
|---|---|---|
| TIINVKCTSPKQCSKPCKELYGSSAGAKCMNGKCK CYNN | NTX | 30 |
| TIINVACTSPKQCSKPCKELYGSSAGAKCMNGKCK CYNN | NTX-A6 | 319 |

TABLE 10-continued

| Noxiustoxin (NTX) peptide and NTX peptide analog sequences | | |
|---|---|---|
| Sequence/structure | Short-hand designation | SEQ ID NO: |
| TIINVKCTSPKQCSKPCKELYGSSRGAKCMNGKCKCYNN | NTX-R25 | 320 |
| TIINVKCTSSKQCSKPCKELYGSSAGAKCMNGKCKCYNN | NTX-S10 | 321 |
| TIINVKCTSPKQCWKPCKELYGSSAGAKCMNGKCKCYNN | NTX-W14 | 322 |
| TIINVKCTSPKQCSKPCKELYGSSGAKCMNGKCKCYNN | NTX-A25d | 323 |
| TIINVKCTSPKQCSKPCKELFGVDRGKCMNGKCKCYNN | NTX-IbTx1 | 324 |
| TIINVKCTSPKQCWKPCKELFGVDRGKCMNGKCKCYN | NTX-IBTX2 | 325 |

TABLE 11

| Kaliotoxin1 (KTX1) peptide and KTX1 peptide analog sequences | | |
|---|---|---|
| Sequence/structure | Short-hand designation | SEQ ID NO: |
| GVEINVKCSGSPQCLKPCKDAGMRFGKCMNRKCHCTPK | KTX1 | 24 |
| VRIPVSCKHSGQCLKPCKDAGMRFGKCMNGKCDCTPK | KTX2 | 326 |
| GVEINVSCSGSPQCLKPCKDAGMRFGKCMNRKCHCTPK | KTX1-S7 | 327 |
| GVEINVACSGSPQCLKPCKDAGMRFGKCMNRKCHCTPK | KTX1-A7 | 328 |

TABLE 12

| IKCa1 inhibitor peptide sequences | | |
|---|---|---|
| Sequence/structure | Short-hand designation | SEQ ID NO: |
| VSCTGSKDCYAPCRKQTGCPNAKCINKSCKCYGC | MTX | 20 |
| QFTNVSCTTSKECWSVCQRLHNTSRGKCMNKKCRCYS | ChTx | 36 |
| QFTQESCTASNQCWSICKRLHNTNRGKCMNKKCRCYS | ChTx-Lq2 | 329 |

TABLE 13

| Maurotoxin (MTx) peptide amd MTx peptide analog sequences | | |
|---|---|---|
| Sequence/structure | Short-hand designation | SEQ ID NO: |
| VSCTGSKDCYAPCRKQTGCPNAKCINKSCKCYGC | MTX | 20 |
| VSCAGSKDCYAPCRKQTGCPNAKCINKSCKCYGC | MTX-A4 | 330 |
| VSCTGAKDCYAPCRKQTGCPNAKCINKSCKCYGC | MTX-A6 | 331 |
| VSCTGSADCYAPCRKQTGCPNAKCINKSCKCYGC | MTX-A7 | 332 |
| VSCTGSKDCAAPCRKQTGCPNAKCINKSCKCYGC | MTX-A10 | 333 |
| VSCTGSKDCYAPCQKQTGCPNAKCINKSCKCYGC | MTX-Q14 | 334 |
| VSCTGSKDCYAPCRQQTGCPNAKCINKSCKCYGC | MTX-Q15 | 335 |
| VSCTGSKDCYAPCQQQTGCPNAKCINKSCKCYGC | MTX-Q14,15 | 336 |
| VSCTGSKDCYAPCRKQTGCPNAKCINKSCKCYAC | MTX-A33 | 337 |
| VSCTGSKDCYAPCRKQTGCPYGKCMNRKCKCNRC | MTX-HsTx1 | 338 |
| VSCTGSKDCYAACRKQTGCANAKCINKSCKCYGC | MTX-A12,20 | 339 |
| VSCTGSKDCYAPCRKQTGX$^{M19}$PNAKCINKSCKCYGX$^{M34}$ | MTX-X19,34 | 340 |
| VSCTGSKDCYAPCRKQTGSPNAKCINKSCKCYGS | MTX-S19,34 | 341 |
| VSCTGSADCYAPCRKQTGCPNAKCINKSCKCYGC | MTX-A7 | 342 |
| VVIGQRCTGSKDCYAPCRKQTGCPNAKCINKSCKCYGC | TsK-MTX | 343 |
| VSCRGSKDCYAPCRKQTGCPNAKCINKSCKCYGC | MTX-R4 | 1301 |
| VSCGGSKDCYAPCRKQTGCPNAKCINKSCKCYGC | MTX-G4 | 1302 |
| VSCTTSKDCYAPCRKQTGCPNAKCINKSCKCYGC | MTX-T5 | 1304 |
| VSCTASKDCYAPCRKQTGCPNAKCINKSCKCYGC | MTX-A5 | 1305 |
| VSCTGTKDCYAPCRKQTGCPNAKCINKSCKCYGC | MTX-T6 | 1306 |
| VSCTGPKDCYAPCRKQTGCPNAKCINKSCKCYGC | MTX-P6 | 1307 |
| VSCTGSKDCGAPCRKQTGCPNAKCINKSCKCYGC | MTX-G10 | 1309 |
| VSCTGSKDCYRPCRKQTGCPNAKCINKSCKCYGC | MTX-R11 | 1311 |
| VSCTGSKDCYDPCRKQTGCPNAKCINKSCKCYGC | MTX-D11 | 1312 |
| VSCTGSKDCYAPCRKRTGCPNAKCINKSCKCYGC | MTX-R16 | 1315 |
| VSCTGSKDCYAPCRKETGCPNAKCINKSCKCYGC | MTX-E16 | 1316 |
| VSCTGSKDCYAPCRKQTGCPYAKCINKSCKCYGC | MTX-Y21 | 1317 |
| VSCTGSKDCYAPCRKQTGCPNSKCINKSCKCYGC | MTX-S22 | 1318 |
| VSCTGSKDCYAPCRKQTGCPNGKCINKSCKCYGC | MTX-G22 | 1319 |
| VSCTGSKDCYAPCRKQTGCPNAKCINRSCKCYGC | MTX-R27 | 1320 |
| VSCTGSKDCYAPCRKQTGCPNAKCINKTCKCYGC | MTX-T28 | 1321 |
| VSCTGSKDCYAPCRKQTGCPNAKCINKMCKCYGC | MTX-M28 | 1322 |
| VSCTGSKDCYAPCRKQTGCPNAKCINKKCKCYGC | MTX-K28 | 1323 |
| VSCTGSKDCYAPCRKQTGCPNAKCINKSCKCNGC | MTX-N32 | 1324 |
| VSCTGSKDCYAPCRKQTGCPNAKCINKSCKCYRC | MTX-R33 | 1325 |

TABLE 13-continued

| Maurotoxin (MTx) peptide amd MTx peptide analog sequences | | |
|---|---|---|
| Sequence/structure | Short-hand designation | SEQ ID NO: |
| VSCTGSKDCYAPCRKQTGCPNAKCINKSCKCYGCS | MTX-S35 | 1326 |
| SCTGSKDCYAPCRKQTGCPNAKCINKSCKCYGC | MTX-d1 | 1327 |
| SCTGSKDCYAPCRKQTGCPNAKCINKSCKCYGCS | MTX-S35d1 | 1328 |
| VSCTGSKDCYAPCAKQTGCPNAKCINKSCKCYGC | MTX-A14 | 1329 |
| VSCTGSKDCYAPCRAQTGCPNAKCINKSCKCYGC | MTX-A15 | 1330 |
| VSCTGSKDCYAPCRKQTGCPNAACINKSCKCYGC | MTX-A23 | 1331 |
| VSCTGSKDCYAPCRKQTGCPNAKCINASCKCYGC | MTX-A27 | 1332 |
| VSCTGSKDCYAPCRKQTGCPNAKCINKSCACYGC | MTX-A30 | 1333 |
| VSCTGSKDCYAPCRKQTGCPNAKCINKSCKCAGC | MTX-A32 | 1334 |
| ASCTGSKDCYAPCRKQTGCPNAKCINKSCKCYGC | MTX-A1 | 1335 |
| MSCTGSKDCYAPCRKQTGCPNAKCINKSCKCYGC | MTX-M1 | 1336 |

In Table 13 and throughout this specification, $X^{m19}$ and $X^{m34}$ are each independently nonfunctional residues.

TABLE 14

| Charybdotoxin(ChTx) peptide and ChTx peptide analog sequences | | |
|---|---|---|
| Sequence/structure | Short-hand designation | SEQ ID NO: |
| QFTNVSCTTSKECWSVCQRLHNTSRGKCMNKKCRCYS | ChTx | 36 |
| QFTNVSCTTSKECWSVCQRLHNTSRGKCMNKECRCYS | ChTx-E32 | 59 |
| QFTNVSCTTSKECWSVCQRLHNTSRGKCMNKDCRCYS | ChTx-D32 | 344 |
| CTTSKECWSVCQRLHNTSRGKCMNKKCRCYS | ChTx-d1-d6 | 345 |
| QFTNVSCTTSKECWSVCQRLFGVDRGKCMGKKCRCYQ | ChTx-IbTx | 346 |
| QFTNVSCTTSKECWSVCQRLHNTSRGKCMNGKCRCYS | ChTx-G31 | 1369 |
| QFTNVSCTTSKECLSVCQRLHNTSRGKCMNKKCRCYS | ChTx-L14 | 1370 |
| QFTNVSCTTSKECASVCQRLHNTSRGKCMNKKCRCYS | ChTx-A14 | 1371 |
| QFTNVSCTTSKECWAVCQRLHNTSRGKCMNKKCRCYS | ChTx-A15 | 1372 |
| QFTNVSCTTSKECWPVCQRLHNTSRGKCMNKKCRCYS | ChTx-P15 | 1373 |
| QFTNVSCTTSKECWSACQRLHNTSRGKCMNKKCRCYS | ChTx-A16 | 1374 |
| QFTNVSCTTSKECWSPCQRLHNTSRGKCMNKKCRCYS | ChTx-P16 | 1375 |
| QFTNVSCTTSKECWSVCQRLHNTSAGKCMNKKCRCYS | ChTx-A25 | 1376 |
| QFTNVACTTSKECWSVCQRLHNTSRGKCMNKKCRCYS | ChTx-A6 | 1377 |
| QFTNVKCTTSKECWSVCQRLHNTSRGKCMNKKCRCYS | ChTx-K6 | 1378 |
| QFTNVSCTTAKECWSVCQRLHNTSRGKCMNKKCRCYS | ChTx-A10 | 1379 |
| QFTNVSCTTPKECWSVCQRLHNTSRGKCMNKKCRCYS | ChTx-P10 | 1380 |
| QFTNVSCTTSKACWSVCQRLHNTSRGKCMNKKCRCYS | ChTx-A12 | 1381 |
| QFTNVSCTTSKQCWSVCQRLHNTSRGKCMNKKCRCYS | ChTx-Q12 | 1382 |
| AFTNVSCTTSKECWSVCQRLHNTSRGKCMNKKCRCYS | ChTx-A1 | 1383 |
| TFTNVSCTTSKECWSVCQRLHNTSRGKCMNKKCRCYS | ChTx-T1 | 1384 |
| QATNVSCTTSKECWSVCQRLHNTSRGKCMNKKCRCYS | ChTx-A2 | 1385 |
| QITNVSCTTSKECWSVCQRLHNTSRGKCMNKKCRCYS | ChTx-I2 | 1386 |
| QFANVSCTTSKECWSVCQRLHNTSRGKCMNKKCRCYS | ChTx-A3 | 1387 |
| QFINVSCTTSKECWSVCQRLHNTSRGKCMNKKCRCYS | ChTx-I3 | 1388 |

TABLE 14-continued

Charybdotoxin(ChTx) peptide and ChTx peptide analog sequences

| Sequence/structure | Short-hand designation | SEQ ID NO: |
|---|---|---|
| TIINVKCTSPKQCLPPCKAQFGTSRGKCMNKKCRCYSP | ChTx-MgTx | 1389 |
| TIINVSCTSPKQCLPPCKAQFGTSRGKCMNKKCRCYSP | ChTx-MgTx-b | 1390 |

TABLE 15

SKCa inhibitor peptide sequences

| Sequence/structure | Short-hand designation | SEQ ID NO: |
|---|---|---|
| CNCKAPETALCARRCQQHG | Apamin | 68 |
| AFCNLRMCQLSCRSLGLLGKCIGDKCECVKH | ScyTx | 51 |
| AVCNLKRCQLSCRSLGLLGKCIGDKCECVKHG | BmP05 | 50 |
| TVCNLRRCQLSCRSLGLLGKCIGVKCECVKH | P05 | 52 |
| AFCNLRRCELSCRSLGLLGKCIGEECKCVPY | Tamapin | 53 |
| VSCEDCPEHCSTQKAQAKCDNDKCVCEPI | P01 | 16 |
| VVIGQRCYRSPDCYSACKKLVGKATGKCT NGRCDC | TsK | 47 |

TABLE 16

Apamin peptide and peptide analog inhibitor sequences

| Sequence/structure | Short-hand designation | SEQ ID NO: |
|---|---|---|
| CNCKAPETALCARRCQQHG | Apamin (Ap) | 68 |
| CNCXAPETALCARRCQQHG | Ap-X4 | 348 |
| CNCAAPETALCARRCQQHG | Ap-A4 | 349 |
| CNCKAPETALCAXRCQQHG | Ap-X13 | 350 |
| CNCKAPETALCAARCQQHG | Ap-A13 | 351 |
| CNCKAPETALCARXCQQHG | Ap-X14 | 352 |
| CNCKAPETALCARACQQHG | Ap-A14 | 353 |

TABLE 17

Scyllatoxin (ScyTx), BmP05, P05, Tamapin, P01 peptide and peptide analog inhibitor sequences

| Sequence/structure | Short-hand designation | SEQ ID NO: |
|---|---|---|
| AFCNLRMCQLSCRSLGLLGKCIGDKCECVKH | ScyTx | 51 |
| AFCNLRRCQLSCRSLGLLGKCIGDKCECVKH | ScyTx-R7 | 354 |
| AFCNLRMCQLSCRSLGLLGKCMGKKCRCVKH | ScyTx-IbTx | 355 |
| AFSNLRMCQLSCRSLGLLGKSIGDKCECVKH | ScyTx-C/S | 356 |
| AFCNLRRCELSCRSLGLLGKCIGEECKCVPY | Tamapin | 53 |

TABLE 18

BKCa inhibitor peptide sequences

| Sequence/structure | Short-hand designation | SEQ ID NO: |
|---|---|---|
| QFTDVDCSVSKECWSVCKDLFGVDRGKCMGK KCRCYQ | IbTx | 38 |
| TFIDVDCTVSKECWAPCKAAFGVDRGKCMGKK CKCYV | Slotoxin (SloTx) | 39 |
| QFTDVKCTGSKQCWPVCKQMFGKPNGKCMNG KCRCYS | BmTx1 | 40 |
| WCSTCLDLACGASRECYDPCFKAFGRAHGKCM NNKCRCYTN | BuTx | 41 |
| FGLIDVKCFASSECWTACKKVTGSGQGKCQNN QCRCY | MartenTx | 35 |
| ITINVKCTSPQQCLRPCKDRFGQHAGGKCING KCKCYP | CllTx1 | 29 |

TABLE 19

IbTx, Slotoxin, BmTx1, & BuTX (Slotoxin family) peptide and peptide analog inhibitor sequences

| Sequence/structure | Short-hand designation | SEQ ID NO: |
|---|---|---|
| QFTDVDCSVSKECWSVCKDLFGVDRGKCMGKKCRCYQ | IbTx | 38 |
| QFTDVDCSVSXECWSVCKDLFGVDRGKCMGKKCRCYQ | IbTx-X11 | 357 |
| QFTDVDCSVSAECWSVCKDLFGVDRGKCMGKKCRCYQ | IbTx-A11 | 358 |
| QFTDVDCSVSKECWSVCXDLFGVDRGKCMGKKCRCYQ | IbTx-X18 | 359 |

TABLE 19-continued

IbTx, Slotoxin, BmTx1, & BuTX (Slotoxin family) peptide and peptide analog inhibitor sequences

| Sequence/structure | Short-hand designation | SEQ ID NO: |
|---|---|---|
| QFTDVDCSVSKECWSVCADLFGVDRGKCMGKKCRCYQ | IbTx-A18 | 360 |
| QFTDVDCSVSKECWSVCKDLFGVDXGKCMGKKCRCYQ | IbTx-X25 | 361 |
| QFTDVDCSVSKECWSVCKDLFGVDAGKCMGKKCRCYQ | IbTx-A25 | 362 |
| QFTDVDCSVSKECWSVCKDLFGVDRGXCMGKKCRCYQ | IbTx-X27 | 363 |
| QFTDVDCSVSKECWSVCKDLFGVDRGACMGKKCRCYQ | IbTx-A27 | 364 |
| QFTDVDCSVSKECWSVCKDLFGVDRGKCMGXKCRCYQ | IbTx-X31 | 365 |
| QFTDVDCSVSKECWSVCKDLFGVDRGKCMGAKCRCYQ | IbTx-A31 | 366 |
| QFTDVDCSVSKECWSVCKDLFGVDRGKCMGKXCRCYQ | IbTx-X32 | 367 |
| QFTDVDCSVSKECWSVCKDLFGVDRGKCMGKACRCYQ | IbTx-A32 | 368 |
| QFTDVDCSVSKECWSVCKDLFGVDRGKCMGKKCXCYQ | IbTx-X34 | 369 |
| QFTDVDCSVSKECWSVCKDLFGVDRGKCMGKKCACYQ | IbTx-A34 | 370 |
| QFTDVKCTGSKQCWPVCKQMFGKPNGKCMNGKCRCYS | BmTx1 | 371 |
| QFTDVXCTGSKQCWPVCKQMFGKPNGKCMNGKCRCYS | BmTx1-X6 | 372 |
| QFTDVACTGSKQCWPVCKQMFGKPNGKCMNGKCRCYS | BmTx1-A6 | 373 |
| QFTDVKCTGSXQCWPVCKQMFGKPNGKCMNGKCRCYS | BmTx1-X11 | 374 |
| QFTDVKCTGSAQCWPVCKQMFGKPNGKCMNGKCRCYS | BmTx1-A11 | 375 |
| QFTDVKCTGSKQCWPVCXQMFGKPNGKCMNGKCRCYS | BmTx1-X18 | 376 |
| QFTDVKCTGSKQCWPVCAQMFGKPNGKCMNGKCRCYS | BmTx1-A18 | 377 |
| QFTDVKCTGSKQCWPVCKQMFGXPNGKCMNGKCRCYS | BmTx1-X23 | 378 |
| QFTDVKCTGSKQCWPVCKQMFGAPNGKCMNGKCRCYS | BmTx1-A23 | 379 |
| QFTDVKCTGSKQCWPVCKQMFGKPNGXCMNGKCRCYS | BmTx1-X27 | 380 |
| QFTDVKCTGSKQCWPVCKQMFGKPNGACMNGKCRCYS | BmTx1-A27 | 381 |
| QFTDVKCTGSKQCWPVCKQMFGKPNGKCMNGXCRCYS | BmTx1-X32 | 382 |
| QFTDVKCTGSKQCWPVCKQMFGKPNGKCMNGARCYS | BmTx1-A32 | 383 |
| QFTDVKCTGSKQCWPVCKQMFGKPNGKCMNGKCXYS | BmTx1-X34 | 384 |
| QFTDVKCTGSKQCWPVCKQMFGKPNGKCMNGKCAYS | BmTx1-A34 | 385 |
| WCSTCLDLACGASRECYDPCFKAFGRAHGKCMNNKCRCYTN | BuTx | 386 |
| WCSTCLDLACGASXCYDPCFKAFGRAHGKCMNNKCRCYTN | BuTx-X14 | 387 |
| WCSTCLDLACGASACYDPCFKAFGRAHGKCMNNKCRCYTN | BuTx-A14 | 388 |
| WCSTCLDLACGASRECYDPCFXFGRAHGKCMNNKCRCYTN | BuTx-X22 | 389 |
| WCSTCLDLACGASRECYDPCFAGRAHGKCMNNKCRCYTN | BuTx-A22 | 390 |
| WCSTCLDLACGASRECYDPCFKAFGXHGKCMNNKCRCYTN | BuTx-X26 | 391 |
| WCSTCLDLACGASRECYDPCFKAFGAHGKCMNNKCRCYTN | BuTx-A26 | 392 |
| WCSTCLDLACGASRECYDPCFKAFGRAHGXMNNKCRCYTN | BuTx-X30 | 393 |
| WCSTCLDLACGASRECYDPCFKAFGRAHGAMNNKCRCYTN | BuTx-A30 | 394 |
| WCSTCLDLACGASRECYDPCFKAFGRAHGKCMNNXRCYTN | BuTx-X35 | 395 |

TABLE 19-continued

IbTx, Slotoxin, BmTx1, & BuTX (Slotoxin family) peptide and peptide analog inhibitor sequences

| Sequence/structure | Short-hand designation | SEQ ID NO: |
|---|---|---|
| WCSTCLDLACGASRECYDPCFKAFGRAHGKCMNNARCYTN | BuTx-A35 | 396 |
| WCSTCLDLACGASRECYDPCFKAFGRAHGKCMNNKCXYTN | BuTx-X37 | 397 |
| WCSTCLDLACGASRECYDPCFKAFGRAHGKCMNNKCAYTN | BuTx-A37 | 398 |

TABLE 20

Martentoxin peptide and peptide analog inhibitor sequences

| Sequence/structure | Short-hand designation | SEQ ID NO: |
|---|---|---|
| FGLIDVKCFASSECWTACKKVTGSGQGKCQNNQCRCY | MartenTx | 35 |
| FGLIDVXCFASSECWTACKKVTGSGQGKCQNNQCRCY | MartenTx-X7 | 399 |
| FGLIDVACFASSECWTACKKVTGSGQGKCQNNQCRCY | MartenTx-A7 | 400 |
| FGLIDVKCFASSECWTACXKVTGSGQGKCQNNQCRCY | MartenTx-X19 | 401 |
| FGLIDVKCFASSECWTACAKVTGSGQGKCQNNQCRCY | MartenTx-A19 | 402 |
| FGLIDVKCFASSECWTACKXVTGSGQGKCQNNQCRCY | MartenTx-X20 | 403 |
| FGLIDVKCFASSECWTACKAVTGSGQGKCQNNQCRCY | MartenTx-A20 | 404 |
| FGLIDVKCFASSECWTACKKVTGSGQGXCQNNQCRCY | MartenTx-X28 | 405 |
| FGLIDVKCFASSECWTACKKVTGSGQGACQNNQCRCY | MartenTx-A28 | 406 |
| FGLIDVKCFASSECWTACKKVTGSGQGKCQNNQCXCY | MartenTx-X35 | 407 |
| FGLIDVKCFASSECWTACKKVTGSGQGKCQNNQCACY | MartenTx-A35 | 408 |

TABLE 21

N type $Ca^{2+}$ channel inhibitor peptide sequences

| Sequence/structure | Short-hand designation | SEQ ID NO: |
|---|---|---|
| CKGKGAKCSRLMYDCCTGSCRSGKC | MVIIA | 65 |
| CKSPGSSCSPTSYNCCRSCNPYTKRCY | GVIA | 64 |
| CKSKGAKCSKLMYDCCTGSCSGTVGRC | CVIA | 409 |
| CKLKGQSCRKTSYDCCSGSCGRSGKC | SVIB | 347 |
| AEKDCIAPGAPCFGTDKPCCNPRAWCSSY ANKCL | Ptu1 | 66 |
| CKGKGASCRKTMYDCCRGSCRSGRC | CVIB | 1364 |
| CKGKGQSCSKLMYDCCTGSCSRRGKC | CVIC | 1365 |
| CKSKGAKCSKLMYDCCSGSCSGTVGRC | CVID | 1366 |
| CLSXGSSCSXTSYNCCRSCNXYSRKCY | TVIA | 1367 |

TABLE 22

ωMVIIA peptide and peptide analog inhibitor sequences

| Sequence/structure | Short-hand designation | SEQ ID NO: |
|---|---|---|
| CKGKGAKCSRLMYDCCTGSCRSGKC | MVIIA | 65 |
| CXGKGAKCSRLMYDCCTGSCRSGKC | MVIIA-X2 | 410 |
| CAGKGAKCSRLMYDCCTGSCRSGKC | MVIIA-A2 | 411 |
| CKGXGAKCSRLMYDCCTGSCRSGKC | MVIIA-X4 | 412 |
| CKGAGAKCSRLMYDCCTGSCRSGKC | MVIIA-A4 | 413 |
| CKGKGAXCSRLMYDCCTGSCRSGKC | MVIIA-X7 | 414 |
| CKGKGAACSRLMYDCCTGSCRSGKC | MVIIA-A7 | 415 |
| CKGKGAKCSXLMYDCCTGSCRSGKC | MVIIA-X10 | 416 |
| CKGKGAKCSALMYDCCTGSCRSGKC | MVIIA-A10 | 417 |
| CKGKGAKCSRLMYDCCTGSCXSGKC | MVIIA-X21 | 418 |

TABLE 22-continued

| ωMVIIA peptide and peptide analog inhibitor sequences | | |
|---|---|---|
| Sequence/structure | Short-hand designation | SEQ ID NO: |
| CKGKGAKCSRLMYDCCTGSCASGKC | MVIIA-A21 | 419 |
| CKGKGAKCSRLMYDCCTGSCRSGXC | MVIIA-X24 | 420 |
| CKGKGAKCSRLMYDCCTGSCRSGAC | MVIIA-A24 | 421 |

TABLE 23

| □GVIA peptide and peptide analog inhibitor sequences | | |
|---|---|---|
| Sequence/structure | Short-hand designation | SEQ ID NO: |
| CKSPGSSCSPTSYNCCRSCNPYTKRCY | GVIA | 64 |
| CXSPGSSCSPTSYNCCRSCNPYTKRCY | GVIA-X2 | 422 |
| CASPGSSCSPTSYNCCRSCNPYTKRCY | GVIA-A2 | 423 |
| CKSPGSSCSPTSYNCCXSCNPYTKRCY | GVIA-X17 | 424 |
| CKSPGSSCSPTSYNCCASCNPYTKRCY | GVIA-A17 | 425 |
| CKSPGSSCSPTSYNCCRSCNPYTXRCY | GVIA-X24 | 426 |
| CKSPGSSCSPTSYNCCRSCNPYTARCY | GVIA-A24 | 427 |
| CKSPGSSCSPTSYNCCRSCNPYTKXCY | GVIA-X25 | 428 |
| CKSPGSSCSPTSYNCCRSCNPYTKACY | GVIA-A25 | 429 |

TABLE 24

| Ptu1 peptide and peptide analog inhibitor sequences | | |
|---|---|---|
| Sequence/structure | Short-hand designation | SEQ ID NO: |
| AEKDCIAPGAPCFGTDKPCCNPRAWCSSYANKCL | Ptu1 | 66 |
| AEXDCIAPGAPCFGTDKPCCNPRAWCSSYANKCL | Ptu1-X3 | 430 |
| AEADCIAPGAPCFGTDKPCCNPRAWCSSYANKCL | Ptu1-A3 | 431 |
| AEKDCIAPGAPCFGTDXPCCNPRAWCSSYANKCL | Ptu1-X17 | 432 |
| AEKDCIAPGAPCFGTDAPCCNPRAWCSSYANKCL | Ptu1-A17 | 433 |
| AEKDCIAPGAPCFGTDKPCCNPXAWCSSYANKCL | Ptu1-X23 | 434 |
| AEKDCIAPGAPCFGTDKPCCNPAAWCSSYANKCL | Ptu1-A23 | 435 |
| AEKDCIAPGAPCFGTDKPCCNPRAWCSSYANXCL | Ptu1-X32 | 436 |
| AEKDCIAPGAPCFGTDKPCCNPRAWCSSYANACL | Ptu1-A32 | 437 |

TABLE 25

| Thrixopelma pruriens (ProTx1) and ProTx1 peptide analogs and other T type $Ca^{2+}$ channel inhibitor peptide sequences | | |
|---|---|---|
| Sequence/structure | Short-hand designation | SEQ ID NO: |
| ECRYWLGGCSAGQTCCKHLVCSRRHGWCVWD GTFS | ProTx1 | 56 |
| ECXYWLGGCSAGQTCCKHLVCSRRHGWCVWD GTFS | ProTx1-X3 | 438 |
| ECAYWLGGCSAGQTCCKHLVCSRRHGWCVWD GTFS | ProTx1-A3 | 439 |
| ECRYWLGGCSAGQTCCXHLVCSRRHGWCVWD GTFS | ProTx1-X17 | 440 |
| ECRYWLGGCSAGQTCCAHLVCSRRHGWCVWD GTFS | ProTx1-A17 | 441 |
| ECRYWLGGCSAGQTCCKHLVCSXRHGWCVWD GTFS | ProTx1-X23 | 442 |
| ECRYWLGGCSAGQTCCKHLVCSARHGWCVWD GTFS | ProTx1-A23 | 443 |
| ECRYWLGGCSAGQTCCKHLVCSRXHGWCVWD GTFS | ProTx1-X24 | 444 |
| ECRYWLGGCSAGQTCCKHLVCSRAHGWCVWD GTFS | ProTx1-A24 | 445 |
| KIDGYPVDYW NCKRICWYNN KYCNDLCKGL KADSGYCWGW TLSCYCQGLP DNARIKRSGR CRA | Kurtoxin | 1276 |

TABLE 26

| BeKM1 M current inhibitor peptide and BeKM1 peptide analog sequences | | |
|---|---|---|
| Sequence/structure | Short-hand designation | SEQ ID NO: |
| RPTDIKCSESYQCFPVCKSRFGKTNGRCVNGFCDCF | BeKM1 | 63 |
| PTDIKCSESYQCFPVCKSRFGKTNGRCVNGFCDCF | BeKM1-d1 | 446 |
| XPTDIKCSESYQCFPVCKSRFGKTNGRCVNGFCDCF | BeKM1-X1 | 447 |
| APTDIKCSESYQCFPVCKSRFGKTNGRCVNGFCDCF | BeKM1-A1 | 448 |
| RPTDIXCSESYQCFPVCKSRFGKTNGRCVNGFCDCF | BeKM1-X6 | 449 |
| RPTDIACSESYQCFPVCKSRFGKTNGRCVNGFCDCF | BeKM1-A6 | 450 |
| RPTDIKCSESYQCFPVCXSRFGKTNGRCVNGFCDCF | BeKM1-X18 | 451 |
| RPTDIKCSESYQCFPVCASRFGKTNGRCVNGFCDCF | BeKM1-A18 | 452 |
| RPTDIKCSESYQCFPVCKSXFGKTNGRCVNGFCDCF | BeKM1-X20 | 453 |

TABLE 26-continued

| BeKM1 M current inhibitor peptide and BeKM1 peptide analog sequences | | |
|---|---|---|
| Sequence/structure | Short-hand designation | SEQ ID NO: |
| RPTDIKCSESYQCFPVCKSAFGKTNGRCVNGFCDCF | BeKM1-A20 | 454 |
| RPTDIKCSESYQCFPVCKSRFGXTNGRCVNGFCDCF | BeKM1-X23 | 455 |
| RPTDIKCSESYQCFPVCKSRFGATNGRCVNGFCDCF | BeKM1-A23 | 456 |
| RPTDIKCSESYQCFPVCKSRFGKTNGXCVNGFCDCF | BeKM1-X27 | 457 |
| RPTDIKCSESYQCFPVCKSRFGKTNGACVNGFCDCF | BeKM1-A27 | 458 |

TABLE 27

| $Na^+$ channel inhibitor peptide sequences | | |
|---|---|---|
| Sequence/structure | Short-hand designation | SEQ ID NO: |
| QRCCNGRRGCSSRWCRDHSRCC | SmIIIa | 459 |
| RDCCTOOKKCKDRQCKOQRCCA | μ-GIIIA | 460 |
| RDCCTOORKCKDRRCKOMRCCA | μ-GIIIB | 461 |
| ZRLCCGFOKSCRSRQCKOHRCC | μ-PIIIA | 462 |
| ZRCCNGRRGCSSRWCRDHSRCC | μ-SmIIIA | 463 |
| ACRKKWEYCIVPIIGFIYCCPGLICGPFVCV | μO-MrVIA | 464 |
| ACSKKWEYCIVPIIGFIYCCPGLICGPFVCV | μO-MrVIB | 465 |
| EACYAOGTFCGIKOGLCCSEFCLPGVCFG | δ-PVIA | 466 |
| DGCSSGGTFCGIHOGLCCSEFCFLWCITFID | δ-SVIE | 467 |
| WCKQSGEMCNLLDQNCCDGYCIVLVCT | δ-TxVIA | 468 |
| VKPCRKEGQLCDPIFQNCCRGWNCVLFCV | δ-GmVIA | 469 |

TABLE 28

| $Cl^-$ channel inhibitor peptide sequences | | |
|---|---|---|
| Sequence/structure | Short-hand designation | SEQ ID NO: |
| MCMPCFTTDHQMARKCDDCCGGKGRGKCYGPQCLCR | CTX | 67 |
| MCMPCFTTDHQMAXKCDDCCGGKGRGKCYGPQCLCR | CTX-X14 | 470 |
| MCMPCFTTDHQMAAKCDDCCGGKGRGKCYGPQCLCR | CTX-A14 | 471 |
| MCMPCFTTDHQMARXCDDCCGGKGRGKCYGPQCLCR | CTX-X15 | 472 |
| MCMPCFTTDHQMARACDDCCGGKGRGKCYGPQCLCR | CTX-A15 | 473 |
| MCMPCFTTDHQMARKCDDCCGGXGRGKCYGPQCLCR | CTX-X23 | 474 |
| MCMPCFTTDHQMARKCDDCCGGAGRGKCYGPQCLCR | CTX-A23 | 475 |
| MCMPCFTTDHQMARKCDDCCGGKGXGKCYGPQCLCR | CTX-X25 | 476 |
| MCMPCFTTDHQMARKCDDCCGGKGAGKCYGPQCLCR | CTX-A25 | 477 |
| MCMPCFTTDHQMARKCDDCCGGKGRGXCYGPQCLCR | CTX-X27 | 478 |
| MCMPCFTTDHQMARKCDDCCGGKGRGACYGPQCLCR | CTX-A27 | 479 |
| MCMPCFTTDHQMARKCDDCCGGKGRGKCYGPQCLCX | CTX-X36 | 480 |
| MCMPCFTTDHQMARKCDDCCGGKGRGKCYGPQCLCA | CTX-A36 | 481 |
| MCMPCFTTDHQMARKCDDCCGGKGRGKCYGPQCLC | CTX-d36 | 482 |
| QTDGCGPCFTTDANMARKCRECCGGNGKCFGPQCLCNRE | Bm-12b | 483 |
| QTDGCGPCFTTDANMAXKCRECCGGNGKCFGPQCLCNRE | Bm-12b-X17 | 484 |
| QTDGCGPCFTTDANMAAKCRECCGGNGKCFGPQCLCNRE | Bm-12b-A17 | 485 |
| QTDGCGPCFTTDANMARXCRECCGGNGKCFGPQCLCNRE | Bm-12b-X18 | 486 |
| QTDGCGPCFTTDANMARACRECCGGNGKCFGPQCLCNRE | Bm-12b-A18 | 487 |
| QTDGCGPCFTTDANMARKCXECCGGNGKCFGPQCLCNRE | Bm-12b-X20 | 488 |
| QTDGCGPCFTTDANMARKCAECCGGNGKCFGPQCLCNRE | Bm-12b-A20 | 489 |

TABLE 28-continued

| Cl⁻ channel inhibitor peptide sequences | | |
|---|---|---|
| Sequence/structure | Short-hand designation | SEQ ID NO: |
| QTDGCGPCFTTDANMARKCRECCGGNGXCFGPQCLCNRE | Bm-12b-X28 | 490 |
| QTDGCGPCFTTDANMARKCRECCGGNGACFGPQCLCNRE | Bm-12b-A28 | 491 |
| QTDGCGPCFTTDANMARKCRECCGGNGKCFGPQCLCNXE | Bm-12b-X38 | 492 |
| QTDGCGPCFTTDANMARKCRECCGGNGKCFGPQCLCNAE | Bm-12b-A38 | 493 |

TABLE 29

| Kv2.1 inhibitor peptide sequences | | |
|---|---|---|
| Sequence/structure | Short-hand designation | SEQ ID NO: |
| ECRYLFGGCKTTSDCCKHLGCKFRDKYCAWDFTFS | HaTx1 | 494 |
| ECXYLFGGCKTTSDCCKHLGCKFRDKYCAWDFTFS | HaTx1-X3 | 495 |
| ECAYLFGGCKTTSDCCKHLGCKFRDKYCAWDFTFS | HaTx1-A3 | 496 |
| ECRYLFGGCXTTSDCCKHLGCKFRDKYCAWDFTFS | HaTx1-X10 | 497 |
| ECRYLFGGCATTSDCCKHLGCKFRDKYCAWDFTFS | HaTx1-A10 | 498 |
| ECRYLFGGCKTTSDCCXHLGCKFRDKYCAWDFTFS | HaTx1-X17 | 499 |
| ECRYLFGGCKTTSDCCAHLGCKFRDKYCAWDFTFS | HaTx1-A17 | 500 |
| ECRYLFGGCKTTSDCCKHLGCXFRDKYCAWDFTFS | HaTx1-X22 | 501 |
| ECRYLFGGCKTTSDCCKHLGCAFRDKYCAWDFTFS | HaTx1-A22 | 502 |
| ECRYLFGGCKTTSDCCKHLGCKFXDKYCAWDFTFS | HaTx1-X24 | 503 |
| ECRYLFGGCKTTSDCCKHLGCKFADKYCAWDFTFS | HaTx1-A24 | 504 |
| ECRYLFGGCKTTSDCCKHLGCKFRDXYCAWDFTFS | HaTx1-X26 | 505 |
| ECRYLFGGCKTTSDCCKHLGCKFRDAYCAWDFTFS | HaTx1-A26 | 506 |

TABLE 30

| Kv4.3 & Kv4.2 inhibitor peptide sequences | | |
|---|---|---|
| Sequence/structure | Short-hand designation | SEQ ID NO: |
| YCQKWMWTCDEERKCCEGLVCRLWCKRIINM | PaTx2 | 57 |
| YCQXWMWTCDEERKCCEGLVCRLWCKRIINM | PaTx2-X4 | 507 |
| YCQAWMWTCDEERKCCEGLVCRLWCKRIINM | PaTx2-A4 | 508 |
| YCQKWMWTCDEEXKCCEGLVCRLWCKRIINM | PaTx2-X13 | 509 |
| YCQKWMWTCDEEAKCCEGLVCRLWCKRIINM | PaTx2-A13 | 510 |
| YCQKWMWTCDEERXCCEGLVCRLWCKRIINM | PaTx2-X14 | 511 |
| YCQKWMWTCDEERACCEGLVCRLWCKRIINM | PaTx2-A14 | 512 |
| YCQKWMWTCDEERKCCEGLVCXLWCKRIINM | PaTx2-X22 | 513 |
| YCQKWMWTCDEERKCCEGLVCALWCKRIINM | PaTx2-A22 | 514 |

TABLE 30-continued

| Kv4.3 & Kv4.2 inhibitor peptide sequences | | |
|---|---|---|
| Sequence/structure | Short-hand designation | SEQ ID NO: |
| YCQKWMWTCDEERKCCEGLVCRLWCXRIINM | PaTx2-X26 | 515 |
| YCQKWMWTCDEERKCCEGLVCRLWCARIINM | PaTx2-A26 | 516 |
| YCQKWMWTCDEERKCCEGLVCRLWCKXIINM | PaTx2-X27 | 517 |
| YCQKWMWTCDEERKCCEGLVCRLWCKAIINM | PaTx2-A27 | 518 |

TABLE 31

| nACHR channel inhibitor peptide sequences | | |
|---|---|---|
| Sequence/structure | Short-hand designation | SEQ ID NO: |
| GCCSLPPCAANNPDYC | PnIA | 519 |
| GCCSLPPCALNNPDYC | PnIA-L10 | 520 |
| GCCSLPPCAASNPDYC | PnIA-S11 | 521 |
| GCCSLPPCALSNPDYC | PnIB | 522 |
| GCCSLPPCAASNPDYC | PnIB-A10 | 523 |
| GCCSLPPCALNNPDYC | PnIB-N11 | 524 |
| GCCSNPVCHLEHSNLC | MII | 525 |
| GRCCHPACGKNYSC | α-MI | 526 |
| RD(hydroxypro)CCYHPTCNMSNPQIC | α-EI | 527 |
| GCCSYPPCFATNPDC | α-AuIB | 528 |
| RDPCCSNPVCTVHNPQIC | α-PIA | 529 |
| GCCSDPRCAWRC | α-ImI | 530 |
| ACCSDRRCRWRC | α-ImII | 531 |
| ECCNPACGRHYSC | α-GI | 532 |
| GCCGSY(hydroxypro)NAACH CSCKDR(hydroxypro)SYCGQ | αA-PIVA | 533 |
| GCCPY(hydroxypro)NAACH(hydroxypro) CGCKVGR(hydroxypro)(hydroxypro) YCDR(hydroxypro)S GG | αA-EIVA | 534 |

TABLE 31-continued

| nAChR channel inhibitor peptide sequences | | |
|---|---|---|
| Sequence/structure | Short-hand designation | SEQ ID NO: |
| H(hydroxypro)(hydroxypro)CCLYGKCRRY (hydroxypro)GCSSASCCQR | ψ-PIIIE | 535 |
| GCCSDPRCNMNNPDYC | EpI | 536 |
| GCCSHPACAGNNQHIC | GIC | 537 |
| IRD(γ-carboxyglu) CCSNPACRVNN (hydroxypro)HVC | GID | 538 |
| GGCCSHPACAANNQDYC | AnIB | 539 |
| GCCSYPPCFATNSDYC | AuIA | 540 |
| GCCSYPPCFATNSGYC | AuIC | 541 |

TABLE 32

| Agelenopsis aperta (Agatoxin) toxin peptides and peptide analogs and other $Ca^{2+}$ channel inhibiter peptides | | |
|---|---|---|
| Sequence/structure | Short-hand designation | SEQ ID NO: |
| KKKCIAKDYG RCKWGGTPCC RGRGCICSIM GTNCECKPRL IMEGLGLA | ω-Aga-IVA | 959 |
| EDNCIAEDYG KCTWGGTKCC RGRPCRCSMI GTNCECTPRL IMEGLSFA | ω-Aga-IVB | 960 |
| SCIDIGGDCD GEKDDCQCCR RNGYCSCYSL FGYLKSGCKC VVGTSAEFQG ICRRKARQCY NSDPDKCESH NKPKRR | ω-Aga-IIIA | 961 |
| SCIDIGGDCD GEKDDCQCCR RNGYCSCYSL FGYLKSGCKC VVGTSAEFQG ICRRKARTCY NSDPDKCESH NKPKRR | ω-Aga-IIIA-T58 | 962 |
| SCIDFGGDCD GEKDDCQCCR SNGYCSCYSL FGYLKSGCKC EVGTSAEFRR ICRRKAKQCY NSDPDKCVSV YKPKRR | ω-Aga-IIIB | 963 |
| SCIDFGGDCD GEKDDCQCCR SNGYCSCYNL FGYLKSGCKC EVGTSAEFRR ICRRKAKQCYNSDPDKCVSV YKPKRR | ω-Aga-IIIB-N29 | 964 |
| SCIDFGGDCD GEKDDCQCCR SNGYCSCYNL FGYLRSGCKC EVGTSAEFRR ICRRKAKQCY NSDPDKCVSV YKPKRR | ω-Aga-IIIB-N29/R35 | 965 |
| NCIDFGGDCD GEKDDCQCCX RNGYCSCYNL FGYLKRGCKX EVG | ω-Aga-IIIC | 966 |
| SCIKIGEDCD GDKDDCQCCR TNGYCSXYXL FGYLKSG | ω-Aga-IIID | 967 |
| GCIEIGGDCD GYQEKSYCQC CRNNGFCS | ω-Aga-IIA | 968 |
| AKAL PPGSVCDGNE SDCKCYGKWH KCRCPWKWHF TGEGPCTCEK GMKHTCITKL HCPNKAEWGL DW | ω-Aga-IA (major chain) | 969 |
| ECVPENGHCR DWYDECCEGF YCSCRQPPKC ICRNNNX | μ-Aga | 970 |
| DCVGESQQCA DWAGPHCCDG YYCTCRYFPK CICVNNN | μ-Aga-6 | 971 |
| ACVGENKQCA DWAGPHCCDG YYCTCRYFPK CICRNNN | μ-Aga-5 | 972 |
| ACVGENQQCA DWAGPHCCDG YYCTCRYFPK CICRNNN | μ-Aga-4 | 973 |
| ADCVGDGQRC ADWAGPYCCS GYYCSCRSMP YCRCRSDS | μ-Aga-3 | 1275 |
| ECATKNKRCA DWAGPWCCDG LYCSCRSYPG CMCRPSS | μ-Aga-2 | 974 |
| ECVPENGHCR DWYDECCEGF YCSCRQPPKC ICRNNN | μ-Aga-1 | 975 |

TABLE 32-continued

Agelenopsis aperta (Agatoxin) toxin peptides and peptide analogs and other $Ca^{2+}$ channel inhibiter peptides

| Sequence/structure | Short-hand designation | SEQ ID NO: |
|---|---|---|
| AELTSCFPVGHECDGDASNCNCCGDDVYCGCGWGRWNCKC KVADQSYAYGICKDKVNCPNRHLWPAKVCKKPCRREC | Tx-1 | 1277 |
| GCANAYKSCNGPHTCCWGYNGYKKACICSGXNWK | Tx3-3 | 1278 |
| SCINVGDFCDGKKDCCQCDRDNAFCSCSVIFGYKTNCRCE | Tx3-4 | 1279 |
| SCINVGDFCDGKKDDCQCCRDNAFCSCSVIFGYKTNCRCE VGTTATSYGICMAKHKCGRQTTCTKPCLSKRCKKNH | ω-PtXIIA | 1280 |
| AECLMTIGDTSCVPRLGRRCCYGAWCYCDQQLSCRRVGRKR ECGWVEVNCKCGWSWSQRIDDWRADYSCKCPEDQ | Dw13.3 | 1281 |
| GGCLPHNRFCNALSGPRCCSGLKCKELSIWDSRCL | Agelenin | 1282 |
| DCVRFWGKCSQTSDCCPHLACKSKWPRNICVWDGSV | ω-GTx-SIA | 1283 |
| GCLEVDYFCG IPFANNGLCC SGNCVFVCTP Q | ω-conotoxin PnVIA | 1284 |
| DDDCEPPGNF CGMIKIGPPC CSGWCFFACA | ω-conotoxin PnVIB | 1285 |
| VCCGYKLCHP C | Lambda-conotoxin CMrVIA | 1286 |
| MRCLPVLIIL LLLTASAPGV VVLPKTEDDV PMSSVYGNGK SILRGILRNG VCCGYKLCHP C | Lambda-conotoxin CMrVIB | 1287 |
| KIDGYPVDYW NCKRICWYNN KYCNDLCKGL KADSGYCWGW TLSCYCQGLP DNARIKRSGR CRA | Kurtoxin | 1276 |
| CKGKGAPCRKTMYDCCSGSCGRRGKC | MVIIC | 1368 |

In accordance with this invention are molecules in which at least one of the toxin peptide (P) portions of the molecule comprises a Kv1.3 antagonist peptide. Amino acid sequences selected from ShK, HmK, MgTx, AgTx1, AgTx2, Heterometrus spinnifer (HsTx1), OSK1, Anuroctoxin (AnTx), Noxiustoxin (NTX), KTX1, Hongotoxin, ChTx, Titystoxin, BgK, BmKTX, BmTx, AeK, AsKS Tc30, Tc32, Pi1, Pi2, and/or Pi3 toxin peptides and peptide analogs of any of these are preferred. Examples of useful Kv1.3 antagonist peptide sequences include those having any amino acid sequence set forth in Table 1, Table 2, Table 3, Table 4, Table 5, Table 6, Table 7, Table 8, Table 9, Table 10, and/or Table 11 herein above;

Other embodiments of the inventive composition include at least one toxin peptide (P) that is an IKCa1 antagonist peptide. Useful IKCa1 antagonist peptides include Maurotoxin (MTx), ChTx, peptides and peptide analogs of either of these, examples of which include those having any amino acid sequence set forth in Table 12, Table 13, and/or Table 14;

Other embodiments of the inventive composition include at least one toxin peptide (P) that is a SKCa inhibitor peptide. Useful SKCa inhibitor peptides include, Apamin, ScyTx, BmP05, P01, P05, Tamapin, TsK, and peptide analogs of any of these, examples of which include those having any amino acid sequence set forth in Table 15;

Other embodiments of the inventive composition include at least one toxin peptide (P) that is an apamin peptide, and peptide analogs of apamin, examples of which include those having any amino acid sequence set forth in Table 16;

Other embodiments of the inventive composition include at least one toxin peptide (P) that is a Scyllotoxin family peptide, and peptide analogs of any of these, examples of which include those having any amino acid sequence set forth in Table 17;

Other embodiments of the inventive composition include at least one toxin peptide (P) that is a BKCa inhibitor peptide, examples of which include those having any amino acid sequence set forth in Table 18;

Other embodiments of the inventive composition include at least one toxin peptide (P) that is a Slotoxin family peptide, and peptide analogs of any of these, examples of which include those having any amino acid sequence set forth in Table 19;

Other embodiments of the inventive composition include at least one toxin peptide (P) that is a Martentoxin peptide, and peptide analogs thereof, examples of which include those having any amino acid sequence set forth in Table 20;

Other embodiments of the inventive composition include at least one toxin peptide (P) that is a N-type $Ca^{2+}$ channel inhibitor peptide, examples of which include those having any amino acid sequence set forth in Table 21;

Other embodiments of the inventive composition include at least one toxin peptide (P) that is a ωMVIIA peptide, and peptide analogs thereof, examples of which include those having any amino acid sequence set forth in Table 22;

Other embodiments of the inventive composition include at least one toxin peptide (P) that is a ωGVIA peptide, and peptide analogs thereof, examples of which include those having any amino acid sequence set forth in Table 23;

Other embodiments of the inventive composition include at least one toxin peptide (P) that is a Ptu1 peptide, and peptide analogs thereof, examples of which include those having any amino acid sequence set forth in Table 24;

Other embodiments of the inventive composition include at least one toxin peptide (P) that is a ProTx1 peptide, and peptide analogs thereof, examples of which include those having any amino acid sequence set forth in Table 25;

Other embodiments of the inventive composition include at least one toxin peptide (P) that is a BeKM1 peptide, and peptide analogs thereof, examples of which include those having any amino acid sequence set forth in Table 26;

Other embodiments of the inventive composition include at least one toxin peptide (P) that is a $Na^+$ channel inhibitor peptide, examples of which include those having any amino acid sequence set forth in Table 27;

Other embodiments of the inventive composition include at least one toxin peptide (P) that is a $Cl^-$ channel inhibitor peptide, examples of which include those having any amino acid sequence set forth in Table 28;

Other embodiments of the inventive composition include at least one toxin peptide (P) that is a Kv2.1 inhibitor peptide, examples of which include those having any amino acid sequence set forth in Table 29;

Other embodiments of the inventive composition include at least one toxin peptide (P) that is a Kv4.2/Kv4.3 inhibitor peptide, examples of which include those having any amino acid sequence set forth in Table 30;

Other embodiments of the inventive composition include at least one toxin peptide (P) that is a nACHR inhibitor peptide, examples of which include those having any amino acid sequence set forth in Table 31; and Other embodiments of the inventive composition include at least one toxin peptide (P) that is an Agatoxin peptide, a peptide analog thereof or other calcium channel inhibitor peptide, examples of which include those having any amino acid sequence set forth in Table 32.

Half-life extending moieties. This invention involves the presence of at least one half-life extending moiety ($F^1$ and/or $F^2$ in Formula I) attached to a peptide through the N-terminus, C-terminus or a sidechain of one of the intracalary amino acid residues. Multiple half-life extending moieties can also be used; e.g., Fc's at each terminus or an Fc at a terminus and a PEG group at the other terminus or at a sidechain. In other embodiments the Fc domain can be PEGylated (e.g., in accordance with the formulae $F^1$—$F^2$-(L)$_f$-P; P-(L)$_g$-$F^1$—$F^2$; or P-(L)$_9$-$F^1$—$F^2$-(L)$_f$-P).

The half-life extending moiety can be selected such that the inventive composition achieves a sufficient hydrodynamic size to prevent clearance by renal filtration in vivo. For example, a half-life extending moiety can be selected that is a polymeric macromolecule, which is substantially straight chain, branched-chain, or dendritic in form. Alternatively, a half-life extending moiety can be selected such that, in vivo, the inventive composition of matter will bind to a serum protein to form a complex, such that the complex thus formed avoids substantial renal clearance. The half-life extending moiety can be, for example, a lipid; a cholesterol group (such as a steroid); a carbohydrate or oligosaccharide; or any natural or synthetic protein, polypeptide or peptide that binds to a salvage receptor.

Exemplary half-life extending moieties that can be used, in accordance with the present invention, include an immunoglobulin Fc domain, or a portion thereof, or a biologically suitable polymer or copolymer, for example, a polyalkylene glycol compound, such as a polyethylene glycol or a polypropylene glycol. Other appropriate polyalkylene glycol compounds include, but are not limited to, charged or neutral polymers of the following types: dextran, polylysine, colominic acids or other carbohydrate based polymers, polymers of amino acids, and biotin derivatives. In some monomeric fusion protein embodiments an immunoglobulin (including light and heavy chains) or a portion thereof, can be used as a half-life-extending moiety, preferably an immunoglobulin of human origin, and including any of the immunoglobulins, such as, but not limited to, IgG1, IgG2, IgG3 or IgG4.

Other examples of the half-life extending moiety, in accordance with the invention, include a copolymer of ethylene glycol, a copolymer of propylene glycol, a carboxymethylcellulose, a polyvinyl pyrrolidone, a poly-1,3-dioxolane, a poly-1,3,6-trioxane, an ethylene/maleic anhydride copolymer, a polyaminoacid (e.g., polylysine), a dextran n-vinyl pyrrolidone, a poly n-vinyl pyrrolidone, a propylene glycol homopolymer, a propylene oxide polymer, an ethylene oxide polymer, a polyoxyethylated polyol, a polyvinyl alcohol, a linear or branched glycosylated chain, a polyacetal, a long chain fatty acid, a long chain hydrophobic aliphatic group, an immunoglobulin light chain and heavy chain, an immunoglobulin Fc domain or a portion thereof (see, e.g., Feige et al., Modified peptides as therapeutic agents, U.S. Pat. No. 6,660,843), a CH2 domain of Fc, an albumin (e.g., human serum albumin (HSA)); see, e.g., Rosen et al., Albumin fusion proteins, U.S. Pat. No. 6,926,898 and US 2005/0054051; Bridon et al., Protection of endogenous therapeutic peptides from peptidase activity through conjugation to blood components, U.S. Pat. No. 6,887,470), a transthyretin (TTR; see, e.g., Walker et al., Use of transthyretin peptide/protein fusions to increase the serum half-life of pharmacologically active peptides/proteins, US 2003/0195154 A1; 2003/0191056 A1), or a thyroxine-binding globulin (TBG). Thus, exemplary embodiments of the inventive compositions also include HSA fusion constructs such as but not limited to: HSA fusions with ShK, OSK1, or modified analogs of those toxin peptides. Examples include HSA-L10-ShK(2-35); HSA-L10-OsK1(1-38); HSA-L10-ShK(2-35); and HSA-L10-OsK1(1-38).

Other embodiments of the half-life extending moiety, in accordance with the invention, include peptide ligands or small (organic) molecule ligands that have binding affinity for a long half-life serum protein under physiological conditions of temperature, pH, and ionic strength. Examples include an albumin-binding peptide or small molecule ligand, a transthyretin-binding peptide or small molecule ligand, a thyroxine-binding globulin-binding peptide or small molecule ligand, an antibody-binding peptide or small molecule ligand, or another peptide or small molecule that has an affinity for a long half-life serum protein. (See, e.g., Blaney et al., Method and compositions for increasing the serum half-life of pharmacologically active agents by binding to transthyretin-selective ligands, U.S. Pat. No. 5,714,142; Sato et al., Serum albumin binding moieties, US 2003/0069395 A1; Jones et al., Pharmaceutical active conjugates, U.S. Pat. No. 6,342,225). A "long half-life serum protein" is one of the hundreds of different proteins dissolved in mammalian blood plasma, including so-called "carrier proteins" (such as albumin, transferrin and haptoglobin), fibrinogen and other blood coagulation factors, complement components, immunoglobulins, enzyme inhibitors, precursors of substances such as angiotensin and bradykinin and many other types of proteins. The invention encompasses the use of any single species of pharmaceutically acceptable half-life extending moiety, such as, but not limited to, those described herein, or the use of a combination of two or more different half-life extending moieties, such as PEG and immunoglobulin Fc domain or a CH2 domain of Fc, albumin (e.g., HSA), an albumin-binding protein, transthyretin or TBG, or a combination such as immunoglobulin (light chain+heavy chain) and Fc domain (the combination so-called "hemibody").

In some embodiments of the invention an Fc domain or portion thereof, such as a CH2 domain of Fc, is used as a half-life extending moiety. The Fc domain can be fused to the N-terminal (e.g., in accordance with the formula $F^1$-$(L)_f$-P) or C-terminal (e.g., in accordance with the formula P-$(L)_g$-$F^1$) of the toxin peptides or at both the N and C termini (e.g., in accordance with the formulae $F^1$-$(L)_f$-P-$(L)_g$-$F^2$ or P-$(L)_g$-$F^1$-$(L)_f$-P). A peptide linker sequence can be optionally included between the Fc domain and the toxin peptide, as described herein. Examples of the formula $F^1$-$(L)_f$-P include: Fc-L10-ShK(K22A)[2-35]; Fc-L10-ShK(R1K/K22A)[1-35]; Fc-L10-ShK(R1H/K22A)[1-35]; Fc-L110-ShK(R1Q/K22A)[1-35]; Fc-L110-ShK(R1Y/K22A)[1-35]; Fc-L10-PP-ShK(K22A) [1-35]; and any other working examples described herein. Examples of the formula P-$(L)_g$-$F^1$ include: ShK(1-35)-L10-Fc; OsK1(1-38)-L10-Fc; Met-ShK(1-35)-L10-Fc; ShK(2-35)-L10-Fc; Gly-ShK(1-35)-L10-Fc; Osk1 (1-38)-L10-Fc; and any other working examples described herein.

Fc variants are suitable half-life extending moieties within the scope of this invention. A native Fc can be extensively modified to form an Fc variant in accordance with this invention, provided binding to the salvage receptor is maintained; see, for example WO 97/34631, WO 96/32478, and WO 04/110 472. In such Fc variants, one can remove one or more sites of a native Fc that provide structural features or functional activity not required by the fusion molecules of this invention. One can remove these sites by, for example, substituting or deleting residues, inserting residues into the site, or truncating portions containing the site. The inserted or substituted residues can also be altered amino acids, such as peptidomimetics or D-amino acids. Fc variants can be desirable for a number of reasons, several of which are described below. Exemplary Fc variants include molecules and sequences in which:

1. Sites involved in disulfide bond formation are removed. Such removal can avoid reaction with other cysteine-containing proteins present in the host cell used to produce the molecules of the invention. For this purpose, the cysteine-containing segment at the N-terminus can be truncated or cysteine residues can be deleted or substituted with other amino acids (e.g., alanyl, seryl). In particular, one can truncate the N-terminal 20-amino acid segment of SEQ ID NO: 2 or delete or substitute the cysteine residues at positions 7 and 10 of SEQ ID NO: 2. Even when cysteine residues are removed, the single chain Fc domains can still form a dimeric Fc domain that is held together non-covalently.
2. A native Fc is modified to make it more compatible with a selected host cell. For example, one can remove the PA sequence near the N-terminus of a typical native Fc, which can be recognized by a digestive enzyme in *E. coli* such as proline iminopeptidase. One can also add an N-terminal methionine residue, especially when the molecule is expressed recombinantly in a bacterial cell such as *E. coli*. The Fc domain of SEQ ID NO: 2 (FIG. 4A-4B) is one such Fc variant.
3. A portion of the N-terminus of a native Fc is removed to prevent N-terminal heterogeneity when expressed in a selected host cell. For this purpose, one can delete any of the first 20 amino acid residues at the N-terminus, particularly those at positions 1, 2, 3, 4 and 5.
4. One or more glycosylation sites are removed. Residues that are typically glycosylated (e.g., asparagine) can confer cytolytic response. Such residues can be deleted or substituted with unglycosylated residues (e.g., alanine).
5. Sites involved in interaction with complement, such as the C1q binding site, are removed. For example, one can delete or substitute the EKK sequence of human IgG1. Complement recruitment may not be advantageous for the molecules of this invention and so can be avoided with such an Fc variant.
6. Sites are removed that affect binding to Fc receptors other than a salvage receptor. A native Fc can have sites for interaction with certain white blood cells that are not required for the fusion molecules of the present invention and so can be removed.
7. The ADCC site is removed. ADCC sites are known in the art; see, for example, *Molec. Immunol.* 29 (5): 633-9 (1992) with regard to ADCC sites in IgG1. These sites, as well, are not required for the fusion molecules of the present invention and so can be removed.
8. When the native Fc is derived from a non-human antibody, the native Fc can be humanized. Typically, to humanize a native Fc, one will substitute selected residues in the non-human native Fc with residues that are normally found in human native Fc. Techniques for antibody humanization are well known in the art.

Preferred Fc variants include the following. In SEQ ID NO: 2, the leucine at position 15 can be substituted with glutamate; the glutamate at position 99, with alanine; and the lysines at positions 101 and 103, with alanines. In addition, phenylalanine residues can replace one or more tyrosine residues.

An alternative half-life extending moiety would be a protein, polypeptide, peptide, antibody, antibody fragment, or small molecule (e.g., a peptidomimetic compound) capable of binding to a salvage receptor. For example, one could use as a half-life extending moiety a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "half-life extending moiety" and are within the scope of this invention. Such half-life extending moieties should be selected for increased half-life (e.g., by avoiding sequences recognized by proteases) and decreased immunogenicity (e.g., by favoring non-immunogenic sequences, as discovered in antibody humanization).

As noted above, polymer half-life extending moieties can also be used for $F^1$ and $F^2$. Various means for attaching chemical moieties useful as half-life extending moieties are currently available, see, e.g., Patent Cooperation Treaty ("PCT") International Publication No. WO 96/11953, entitled "N-Terminally Chemically Modified Protein Compositions and Methods," herein incorporated by reference in its entirety. This PCT publication discloses, among other things, the selective attachment of water-soluble polymers to the N-terminus of proteins.

In some embodiments of the inventive compositions, the polymer half-life extending moiety is polyethylene glycol (PEG), as $F^1$ and/or $F^2$, but it should be understood that the inventive composition of matter, beyond positions $F^1$ and/or $F^2$, can also include one or more PEGs conjugated at other sites in the molecule, such as at one or more sites on the toxin peptide. Accordingly, some embodiments of the inventive composition of matter further include one or more PEG moieties conjugated to a non-PEG half-life extending moiety, which is $F^1$ and/or $F^2$, or to the toxin peptide(s) (P), or to any combination of any of these. For example, an Fc domain or portion thereof (as F1 and/or F2) in the inventive composition can be made mono-PEGylated, di-PEGylated, or otherwise multi-PEGylated, by the process of reductive alkylation.

Covalent conjugation of proteins and peptides with poly (ethylene glycol) (PEG) has been widely recognized as an approach to significantly extend the in vivo circulating half-lives of therapeutic proteins. PEGylation achieves this effect predominately by retarding renal clearance, since the PEG moiety adds considerable hydrodynamic radius to the protein. (Zalipsky, S., et al., Use of functionalized poly(ethylene glycol)s for modification of polypeptides., in poly(ethylene glycol) chemistry: Biotechnical and biomedical applications, J. M. Harris, Ed., Plenum Press: New York, 347-370 (1992)). Additional benefits often conferred by PEGylation of proteins and peptides include increased solubility, resistance to proteolytic degradation, and reduced immunogenicity of the therapeutic polypeptide. The merits of protein PEGylation are evidenced by the commercialization of several PEGylated proteins including PEG-Adenosine deaminase (Adagen™/Enzon Corp.), PEG-L-asparaginase (Oncaspar™/Enzon Corp.), PEG-Interferon α-2b (PEG-Intron™/Schering/Enzon), PEG-Interferon α-2a (PEGASYS™/Roche) and PEG-G-CSF (Neulasta™/Amgen) as well as many others in clinical trials.

Briefly, the PEG groups are generally attached to the peptide portion of the composition of the invention via acylation or reductive alkylation (or reductive amination) through a reactive group on the PEG moiety (e.g., an aldehyde, amino, thiol, or ester group) to a reactive group on the inventive compound (e.g., an aldehyde, amino, or ester group).

Figures 5A, 5B:
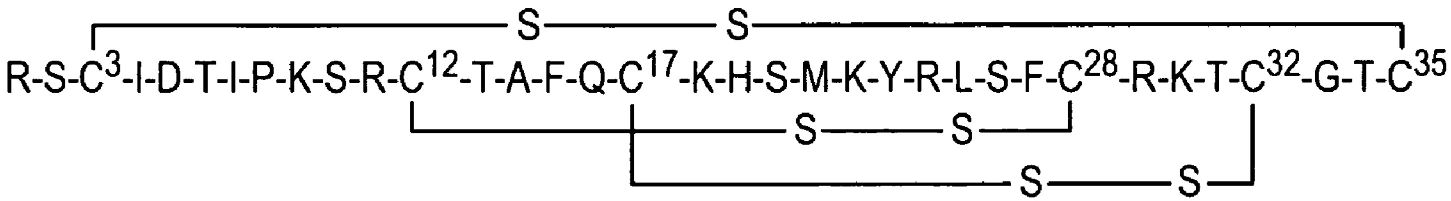
FIG. 5A shows the amino acid sequence of the mature ShK peptide (SEQ ID NO: 5), which can be encoded for by a nucleic acid sequence containing codons optimized for expression in mammalian cell, bacteria or yeast.
FIG. 5B shows the three disulfide bonds (—S—S—) formed by the six cysteines within the ShK peptide (SEQ ID NO: 10).
Figure 7B:
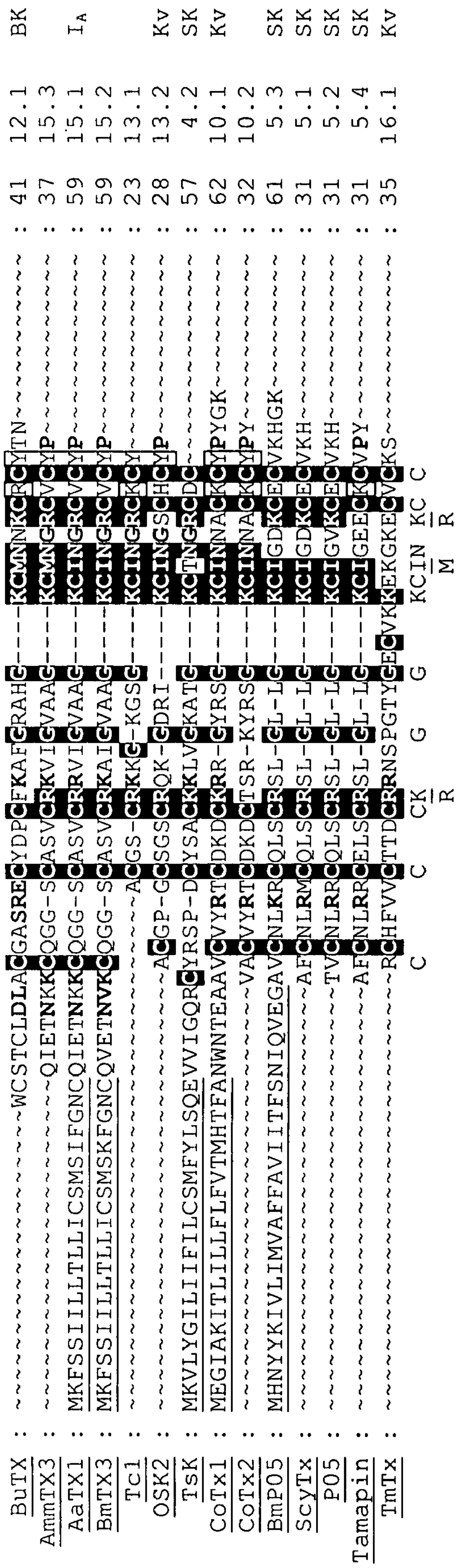
Figure 10:
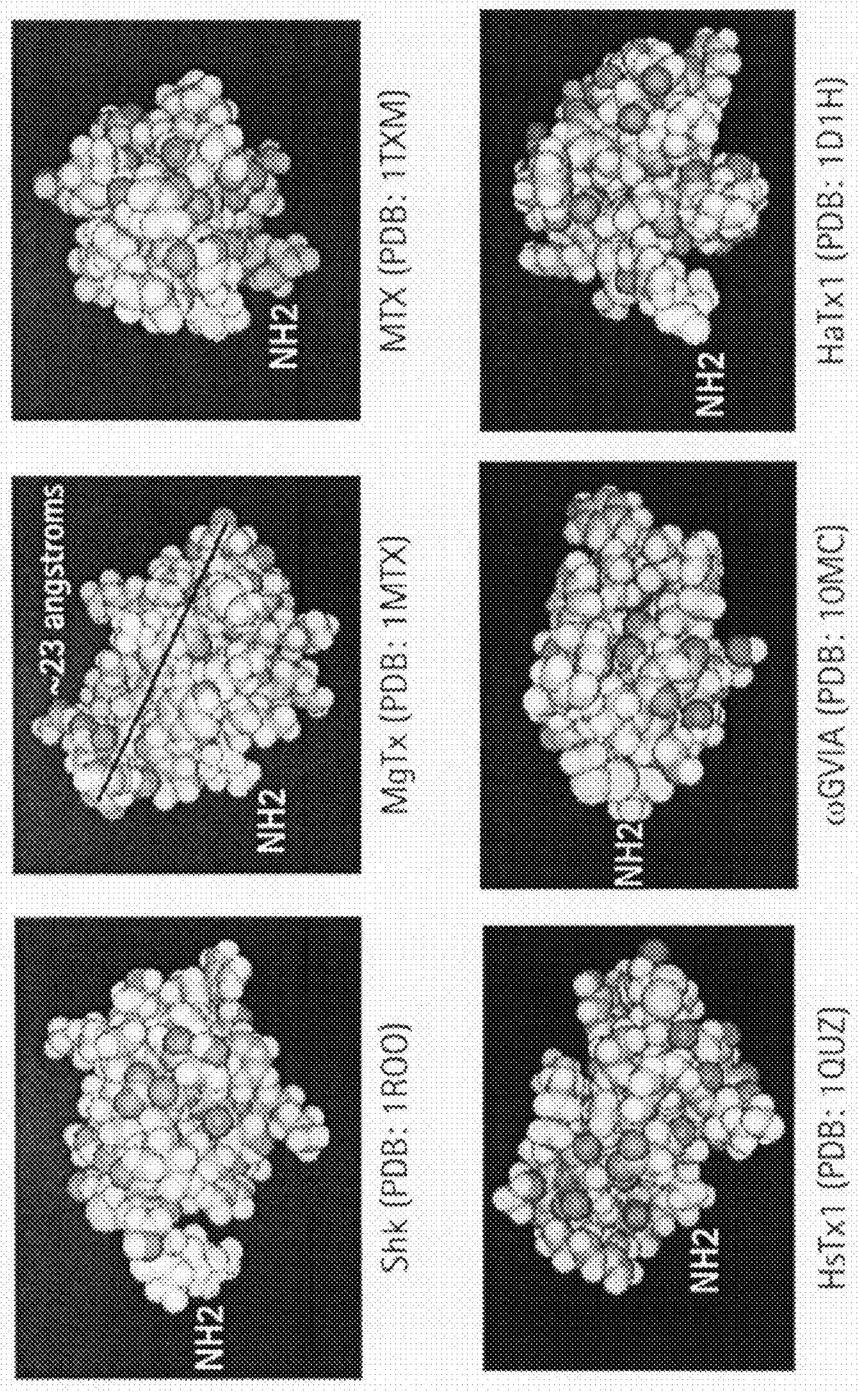
FIG. 10 illustrates that solution structures of toxins reveal a compact structure. Solution structures of native toxins from sea anemone (ShK), scorpion (MgTx, MTX, HsTx1), marine cone snail (wGVIA) and tarantula (HaTx1) indicate the 28 to 39 amino acid peptides all form a compact structure. The toxins shown have 3 or 4 disulfide linkages and fall within 4 of the 6 subfamilies shown in FIG. 9. The solution structures of native toxins from sea anemone (ShK), scorpion (MgTx, MTX, HsTx1), marine cone snail (wGVIA) and tarantula (HaTx1) were derived from Protein Data Bank (PDB) accession numbers 1ROO (mmdbld:5247), 1MTX (mmdbld: 4064), 1TXM (mmdbld:6201), 1QUZ (mmdbld:36904), 1OMZ (mmdbld:1816) and 1D1H (mmdbld:14344) using the MMDB Entrez 3D-structure database [J. Chen et al. (2003) Nucleic Acids Res. 31, 474] and viewer.

A useful strategy for the PEGylation of synthetic peptides consists of combining, through forming a conjugate linkage in solution, a peptide and a PEG moiety, each bearing a special functionality that is mutually reactive toward the other. The peptides can be easily prepared with conventional solid phase synthesis (see, for example, FIGS. 5 and 6 and the accompanying text herein). The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

PEG is a well-known, water soluble polymer that is commercially available or can be prepared by ring-opening polymerization of ethylene glycol according to methods well known in the art (Sandler and Karo, Polymer Synthesis, Academic Press, New York, Vol. 3, pages 138-161). In the present application, the term "PEG" is used broadly to encompass any polyethylene glycol molecule, in mono-, bi-, or poly-functional form, without regard to size or to modification at an end of the PEG, and can be represented by the formula:

$$X—O(CH_2CH_2O)_{n-1}CH_2CH_2OH, \qquad (X)$$

where n is 20 to 2300 and X is H or a terminal modification, e.g., a $C_{1-4}$ alkyl.

In some useful embodiments, a PEG used in the invention terminates on one end with hydroxy or methoxy, i.e., X is H or $CH_3$ ("methoxy PEG"). It is noted that the other end of the PEG, which is shown in formula (II) terminating in OH, covalently attaches to an activating moiety via an ether oxygen bond, an amine linkage, or amide linkage. When used in a chemical structure, the term "PEG" includes the formula (II) above without the hydrogen of the hydroxyl group shown, leaving the oxygen available to react with a free carbon atom of a linker to form an ether bond. More specifically, in order to conjugate PEG to a peptide, the peptide must be reacted with PEG in an "activated" form. Activated PEG can be represented by the formula:

$$(PEG)\text{-}(A) \qquad (XI)$$

where PEG (defined supra) covalently attaches to a carbon atom of the activation moiety (A) to form an ether bond, an amine linkage, or amide linkage, and (A) contains a reactive group which can react with an amino, azido, alkyne, imino, maleimido, N-succinimidyl, carboxyl, aminooxy, seleno, or thiol group on an amino acid residue of a peptide or a linker moiety covalently attached to the peptide, e.g., the OSK1 peptide analog. Residues baring chemoselective reactive groups can be introduced into the toxin peptide, e.g., an OSK1 peptide analog during assembly of the peptide sequence solid-phase synthesis as protected derivatives. Alternatively, chemoselective reactive groups can be introduced in the toxin peptide after assembly of the peptide sequence by solid-phase synthesis via the use of orthogonal protecting groups at specific sites. Examples of amino acid residues useful for chemoselective reactions include, but are not limited to, (amino-oxyacetyl)-L-diaminopropionic acid, p-azido-phenylalanine, azidohomolalanine, para-propargyloxy-phenylalanine, selenocysteine, para-acetylphenylalanine, ($N^\epsilon$-levulinyl)-Lysine, ($N^\epsilon$-pyruvyl)-Lysine, selenocysteine, and orthogonally protected cysteine and homocysteine.

Accordingly, in some embodiments of the composition of matter, the toxin peptide, e.g., the OSK1 peptide analog, is conjugated to a polyethylene glycol (PEG) at:

(a) 1, 2, 3 or 4 amino functionalized sites in the toxin peptide;

(b) 1, 2, 3 or 4 thiol functionalized sites in the toxin peptide; (c) 1 or 2 ketone functionalized sites in the toxin peptide; (d) 1 or 2 azido functionalized sites of the toxin peptide; (e) 1 or 2 carboxyl functionalized sites in the toxin peptide; (f) 1 or 2 aminooxy functionalized sites in the toxin peptide; or (g) 1 or 2 seleno functionalized sites in the toxin peptide.

In other embodiments of the composition of matter, the toxin peptide, e.g., the OSK1 peptide analog, is conjugated to a polyethylene glycol (PEG) at:

(a) 1, 2, 3 or 4 amino functionalized sites of the PEG;

(b) 1, 2, 3 or 4 thiol functionalized sites of the PEG;

(c) 1, 2, 3 or 4 maleimido functionalized sites of the PEG;

(d) 1, 2, 3 or 4 N-succinimidyl functionalized sites of the PEG;

(e) 1, 2, 3 or 4 carboxyl functionalized sites of the PEG; or (f) 1, 2, 3 or 4 p-nitrophenyloxycarbonyl functionalized sites of the PEG.

Techniques for the preparation of activated PEG and its conjugation to biologically active peptides are well known in the art. (E.g., see U.S. Pat. Nos. 5,643,575, 5,919,455, 5,932,462, and 5,990,237; Thompson et al., PEGylation of polypeptides, EP 0575545 B1; Petit, Site specific protein modification, U.S. Pat. Nos. 6,451,986, and 6,548,644; S. Herman et al., Poly(ethylene glycol) with reactive endgroups: I. Modification of proteins, J. Bioactive Compatible Polymers, 10:145-187 (1995); Y. Lu et al., Pegylated peptides III: Solid-phase synthesis with PEGylating reagents of varying molecular weight: synthesis of multiply PEGylated peptides, Reactive Polymers, 22:221-229 (1994); A. M. Felix et al., PEGylated Peptides IV: Enhanced biological activity of site-directed PEGylated GRF analogs, Int. J. Peptide Protein Res., 46:253-264 (1995); A. M. Felix, Site-specific poly(ethylene glycol)ylation of peptides, ACS Symposium Series 680(poly (ethylene glycol)): 218-238 (1997); Y. Ikeda et al., Polyethylene glycol derivatives, their modified peptides, methods for producing them and use of the modified peptides, EP 0473084 B1; G. E. Means et al., Selected techniques for the modification of protein side chains, in: Chemical modification of proteins, Holden Day, Inc., 219 (1971)).

Activated PEG, such as PEG-aldehydes or PEG-aldehyde hydrates, can be chemically synthesized by known means or obtained from commercial sources, e.g., Shearwater Polymers, (Huntsville, Ala.) or Enzon, Inc. (Piscataway, N.J.).

An example of a useful activated PEG for purposes of the present invention is a PEG-aldehyde compound (e.g., a methoxy PEG-aldehyde), such as PEG-propionaldehyde, which is commercially available from Shearwater Polymers (Huntsville, Ala.). PEG-propionaldehyde is represented by the formula PEG-$CH_2CH_2CHO$. (See, e.g., U.S. Pat. No. 5,252, 714). Other examples of useful activated PEG are PEG acetaldehyde hydrate and PEG bis aldehyde hydrate, which latter yields a bifunctionally activated structure. (See, e.g., Bentley et al., Poly(ethylene glycol) aldehyde hydrates and related polymers and applications in modifying amines, U.S. Pat. No. 5,990,237).

Another useful activated PEG for generating the PEG-conjugated peptides of the present invention is a PEG-maleimide compound, such as, but not limited to, a methoxy PEG-maleimide, such as maleimido monomethoxy PEG, are particularly useful for generating the PEG-conjugated peptides of the invention. (E.g., Shen, N-maleimidyl polymer derivatives, U.S. Pat. No. 6,602,498; C. Delgado et al., The uses and properties of PEG-linked proteins, Crit. Rev. Therap. Drug Carrier Systems, 9:249-304 (1992); S. Zalipsky et al., Use of functionalized poly(ethylene glycol)s for modification of polypeptides, in: Poly(ethylene glycol) chemistry: Biotechnical and biomedical applications (J. M. Harris, Editor, Plenum Press: New York, 347-370 (1992); S. Herman et al., Poly(ethylene glycol) with reactive endgroups: I. Modification of proteins, J. Bioactive Compatible Polymers, 10:145-187 (1995); P. J. Shadle et al., Conjugation of polymer to colony stimulating factor-1, U.S. Pat. No. 4,847,325; G. Shaw et al., Cysteine added variants IL-3 and chemical modifications thereof, U.S. Pat. No. 5,166,322 and EP 0469074 B1; G. Shaw et al., Cysteine added variants of EPO and chemical modifications thereof, EP 0668353 A1; G. Shaw et al., Cysteine added variants G-CSF and chemical modifications thereof, EP 0668354 A1; N. V. Katre et al., Interleukin-2 muteins and polymer conjugation thereof, U.S. Pat. No. 5,206,344; R. J. Goodson and N. V. Katre, Site-directed pegylation of recombinant interleukin-2 at its glycosylation site, Biotechnology, 8:343-346 (1990)).

A poly(ethylene glycol) vinyl sulfone is another useful activated PEG for generating the PEG-conjugated peptides of the present invention by conjugation at thiolated amino acid residues, e.g., at C residues. (E.g., M. Morpurgo et al., Preparation and characterization of poly(ethylene glycol) vinyl sulfone, Bioconj. Chem., 7:363-368 (1996); see also Harris, Functionalization of polyethylene glycol for formation of active sulfone-terminated PEG derivatives for binding to proteins and biologically compatible materials, U.S. Pat. Nos. 5,446,090; 5,739,208; 5,900,461; 6,610,281 and 6,894,025; and Harris, Water soluble active sulfones of poly(ethylene glycol), WO 95/13312 A1).

Another activated form of PEG that is useful in accordance with the present invention, is a PEG-N-hydroxysuccinimide ester compound, for example, methoxy PEG-N-hydroxysuccinimidyl (NHS) ester.

Heterobifunctionally activated forms of PEG are also useful. (See, e.g., Thompson et al., PEGylation reagents and biologically active compounds formed therewith, U.S. Pat. No. 6,552,170).

Typically, a toxin peptide or, a fusion protein comprising the toxin peptide, is reacted by known chemical techniques with an activated PEG compound, such as but not limited to, a thiol-activated PEG compound, a diol-activated PEG compound, a PEG-hydrazide compound, a PEG-oxyamine compound, or a PEG-bromoacetyl compound. (See, e.g., S. Herman, Poly(ethylene glycol) with Reactive Endgroups: I. Modification of Proteins, J. Bioactive and Compatible Polymers, 10:145-187 (1995); S. Zalipsky, Chemistry of Polyethylene Glycol Conjugates with Biologically Active Molecules, Advanced Drug Delivery Reviews, 16:157-182 (1995); R. Greenwald et al., Poly(ethylene glycol) conjugated drugs and prodrugs: a comprehensive review, Critical Reviews in Therapeutic Drug Carrier Systems, 17:101-161 (2000)).

Methods for N-terminal PEGylation are exemplified herein in Examples 31-34, 45 and 47-48, but these are in no way limiting of the PEGylation methods that can be employed by one skilled in the art.

Any molecular mass for a PEG can be used as practically desired, e.g., from about 1,000 or 2,000 Daltons (Da) to about 100,000 Da (n is 20 to 2300). Preferably, the combined or total molecular mass of PEG used in a PEG-conjugated peptide of the present invention is from about 3,000 Da or 5,000 Da, to about 50,000 Da or 60,000 Da (total n is from 70 to 1,400), more preferably from about 10,000 Da to about 40,000 Da (total n is about 230 to about 910). The most preferred combined mass for PEG is from about 20,000 Da to about 30,000 Da (total n is about 450 to about 680). The number of repeating units "n" in the PEG is approximated for the molecular mass described in Daltons. It is preferred that the combined molecular mass of PEG on an activated linker is suitable for pharmaceutical use. Thus, the combined molecular mass of the PEG molecule should not exceed about 100, 000 Da.

Polysaccharide polymers are another type of water-soluble polymer that can be used for protein modification. Dextrans are polysaccharide polymers comprised of individual subunits of glucose predominantly linked by α1-6 linkages. The dextran itself is available in many molecular weight ranges, and is readily available in molecular weights from about 1 kDa to about 70 kDa. Dextran is a suitable water-soluble polymer for use in the present invention as a half-life extending moiety by itself or in combination with another half-life extending moiety (e.g., Fc). See, for example, WO 96/11953 and WO 96/05309. The use of dextran conjugated to therapeutic or diagnostic immunoglobulins has been reported; see, for example, European Patent Publication No. 0 315 456, which is hereby incorporated by reference in its entirety. Dextran of about 1 kDa to about 20 kDa is preferred when dextran is used as a half-life extending moiety in accordance with the present invention.

Linkers. Any "linker" group or moiety (i.e., "-$(L)_g$-" or "-$(L)_g$-" in Formulae I-IX) is optional. When present, its chemical structure is not critical, since it serves primarily as a spacer. As stated herein above, the linker moiety (-$(L)_f$- and/or -$(L)_g$-), if present, can be independently the same or different from any other linker, or linkers, that may be present in the inventive composition. For example, an "$(L)_f$" can represent the same moiety as, or a different moiety from, any other "$(L)_f$" or any "$(L)_g$" in accordance with the invention. The linker is preferably made up of amino acids linked together by peptide bonds. Some of these amino acids can be glycosylated, as is well understood by those in the art. For example, a useful linker sequence constituting a sialylation site is $X_1X_2NX_4X_5G$ (SEQ ID NO: 637), wherein $X_1$, $X_2$, $X_4$ and $X_5$ are each independently any amino acid residue.

As stated above, in some embodiments, a peptidyl linker is present (i.e., made up of amino acids linked together by peptide bonds) that is made in length, preferably, of from 1 up to about 40 amino acid residues, more preferably, of from 1 up to about 20 amino acid residues, and most preferably of from 1 to about 10 amino acid residues. Preferably, but not necessarily, the amino acid residues in the linker are from among the twenty canonical amino acids, more preferably, cysteine, glycine, alanine, proline, asparagine, glutamine, and/or serine. Even more preferably, a peptidyl linker is made up of a majority of amino acids that are sterically unhindered, such as glycine, serine, and alanine linked by a peptide bond. It is also desirable that, if present, a peptidyl linker be selected that avoids rapid proteolytic turnover in circulation in vivo. Thus, preferred linkers include polyglycines (particularly $(Gly)_4$ (SEQ ID NO: 4918), $(Gly)_5$) (SEQ ID NO: 4919), poly(Gly-Ala), and polyalanines. Other preferred linkers are those identified herein as "L5" (GGGGS; SEQ ID NO: 638), "L10" (GGGGSGGGGS; SEQ ID NO:79), "L25" GGGGSGGGGSGGGGSGGGGSGGGGS; SEQ ID NO:84) and any linkers used in the working examples hereinafter. The linkers described herein, however, are exemplary; linkers within the scope of this invention can be much longer and can include other residues.

In some embodiments of the compositions of this invention, which comprise a peptide linker moiety (L), acidic residues, for example, glutamate or aspartate residues, are placed in the amino acid sequence of the linker moiety (L). Examples include the following peptide linker sequences:

| | |
|---|---|
| GGEGGG; | (SEQ ID NO: 639) |
| GGEEEGGG; | (SEQ ID NO: 640) |
| GEEEG; | (SEQ ID NO: 641) |
| GEEE; | (SEQ ID NO: 642) |
| GGDGGG; | (SEQ ID NO: 643) |
| GGDDDGG; | (SEQ ID NO: 644) |
| GDDDG; | (SEQ ID NO: 645) |
| GDDD; | (SEQ ID NO: 646) |
| GGGGSDDSDEGSDGEDGGGGS; | (SEQ ID NO: 647) |
| WEWEW; | (SEQ ID NO: 648) |
| FEFEF; | (SEQ ID NO: 649) |
| EEEWWW; | (SEQ ID NO: 650) |
| EEEFFF; | (SEQ ID NO: 651) |
| WWEEEWW; or | (SEQ ID NO: 652) |
| FFEEEFF. | (SEQ ID NO: 653) |

In other embodiments, the linker constitutes a phosphorylation site, e.g., $X_1X_2YX_3X_4G$ (SEQ ID NO: 654), wherein $X_1$, $X_2$, $X_3$ and $X_4$ are each independently any amino acid residue; $X_1X_2SX_3X_4G$ (SEQ ID NO: 655), wherein $X_1$, $X_2$, $X_3$ and $X_4$ are each independently any amino acid residue; or $X_1X_2TX_3X_4G$ (SEQ ID NO: 656), wherein $X_1$, $X_2$, $X_3$ and $X_4$ are each independently any amino acid residue.

Non-peptide linkers are also possible. For example, alkyl linkers such as $-NH-(CH_2)_s-C(O)-$, wherein s=2-20 could be used. These alkyl linkers can further be substituted by any non-sterically hindering group such as lower alkyl (e.g., $C_1$-$C_6$) lower acyl, halogen (e.g., Cl, Br), CN, $NH_2$, phenyl, etc. An exemplary non-peptide linker is a PEG linker, (XII)

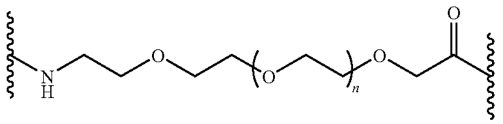

wherein n is such that the linker has a molecular weight of 100 to 5000 kDa, preferably 100 to 500 kDa. The peptide linkers can be altered to form derivatives in the same manner as described above.

Useful linker embodiments also include aminoethyloxyethyloxy-acetyl linkers as disclosed by Chandy et al. (Chandy et al., WO 2006/042151 A2, incorporated herein by reference in its entirety).

Derivatives. The inventors also contemplate derivatizing the peptide and/or half-life extending moiety portion of the compounds. Such derivatives can improve the solubility, absorption, biological half-life, and the like of the compounds. The moieties can alternatively eliminate or attenuate any undesirable side-effect of the compounds and the like. Exemplary derivatives include compounds in which:

1. The compound or some portion thereof is cyclic. For example, the peptide portion can be modified to contain two or more Cys residues (e.g., in the linker), which could cyclize by disulfide bond formation.
2. The compound is cross-linked or is rendered capable of cross-linking between molecules. For example, the peptide portion can be modified to contain one Cys residue and thereby be able to form an intermolecular disulfide bond with a like molecule. The compound can also be cross-linked through its C-terminus, as in the molecule shown below.

(XIII)

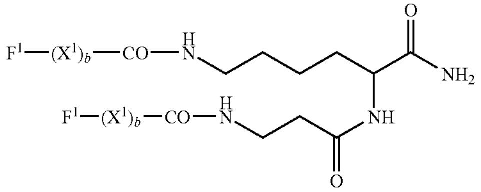

3. Non-peptidyl linkages (bonds) replace one or more peptidyl [$-C(O)NR-$] linkages. Exemplary non-peptidyl linkages are $-CH_2$-carbamate [$-CH_2-OC(O)NR-$], phosphonate, $-CH_2$-sulfonamide [$-CH_2-S(O)_2NR-$], urea [$-NHC(O)NH-$], $-CH_2$-secondary amine, and alkylated peptide [$-C(O)NR^6-$ wherein $R^6$ is lower alkyl].
4. The N-terminus is chemically derivatized. Typically, the N-terminus can be acylated or modified to a substituted amine. Exemplary N-terminal derivative groups include $-NRR^1$ (other than $-NH_2$), $-NRC(O)R^1$, $-NRC(O)OR^1$, $-NRS(O)_2R^1$, $-NHC(O)NHR^1$, succinimide, or benzyloxycarbonyl-NH— (CBZ-NH—), wherein R and $R^1$ are each independently hydrogen or lower alkyl and wherein the phenyl ring can be substituted with 1 to 3 substituents selected from the group consisting of $C_1$-$C_4$ alkyl, $C_1$-$C_4$ alkoxy, chloro, and bromo.

5. The free C-terminus is derivatized. Typically, the C-terminus is esterified or amidated. For example, one can use methods described in the art to add $(NH—CH_2—CH_2—NH_2)_2$ to compounds of this invention having any of SEQ ID NOS: 504 to 508 at the C-terminus. Likewise, one can use methods described in the art to add $—NH_2$ to compounds of this invention having any of SEQ ID NOS: 924 to 955, 963 to 972, 1005 to 1013, or 1018 to 1023 at the C-terminus. Exemplary C-terminal derivative groups include, for example, $—C(O)R^2$ wherein $R^2$ is lower alkoxy or $—NR^3R^4$ wherein $R^3$ and $R^4$ are independently hydrogen or $C_1$-$C_8$ alkyl (preferably $C_1$-$C_4$ alkyl).
6. A disulfide bond is replaced with another, preferably more stable, cross-linking moiety (e.g., an alkylene). See, e.g., Bhatnagar et al. (1996), *J. Med. Chem.* 39: 3814-9; Alberts et al. (1993) *Thirteenth Am. Pep. Symp.*, 357-9.
7. One or more individual amino acid residues are modified. Various derivatizing agents are known to react specifically with selected sidechains or terminal residues, as described in detail below.

Lysinyl residues and amino terminal residues can be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues can be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents can react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) can be selectively modified by reaction with carbodiimides (R'—N═C═N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues can be converted to asparaginyl and glutaminyl residues by reaction with ammonium ions.

Glutaminyl and asparaginyl residues can be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al. (1996), *J. Med. Chem.* 39: 3814-9.

Derivatization with bifunctional agents is useful for cross-linking the peptides or their functional derivatives to a water-insoluble support matrix or to other macromolecular half-life extending moieties. Commonly used cross-linking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Carbohydrate (oligosaccharide) groups can conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids other than proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, can confer acidic properties to the glycosylated compound. Such site(s) can be incorporated in the linker of the compounds of this invention and are preferably glycosylated by a cell during recombinant production of the polypeptide compounds (e.g., in mammalian cells such as CHO, BHK, COS). However, such sites can further be glycosylated by synthetic or semi-synthetic procedures known in the art.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, *Proteins: Structure and Molecule Properties* (W. H. Freeman and Co., San Francisco), pp. 79-86 (1983).

Compounds of the present invention can be changed at the DNA level, as well. The DNA sequence of any portion of the compound can be changed to codons more compatible with the chosen host cell. For *E. coli*, which is the preferred host cell, optimized codons are known in the art. Codons can be substituted to eliminate restriction sites or to include silent restriction sites, which can aid in processing of the DNA in the selected host cell. The half-life extending moiety, linker and peptide DNA sequences can be modified to include any of the foregoing sequence changes.

A process for preparing conjugation derivatives is also contemplated. Tumor cells, for example, exhibit epitopes not found on their normal counterparts. Such epitopes include, for example, different post-translational modifications resulting from their rapid proliferation. Thus, one aspect of this invention is a process comprising:

a) selecting at least one randomized peptide that specifically binds to a target epitope; and
b) preparing a pharmacologic agent comprising (i) at least one half-life extending moiety (Fc domain preferred), (ii) at least one amino acid sequence of the selected peptide or peptides, and (iii) an effector molecule. The target epitope is preferably a tumor-specific epitope or an epitope specific to a pathogenic organism. The effector molecule can be any of the above-noted conjugation partners and is preferably a radioisotope.

Methods of Making

The present invention also relates to nucleic acids, expression vectors and host cells useful in producing the polypeptides of the present invention. Host cells can be eukaryotic cells, with mammalian cells preferred and CHO cells most preferred. Host cells can also be prokaryotic cells, with *E. coli* cells most preferred.

The compounds of this invention largely can be made in transformed host cells using recombinant DNA techniques. To do so, a recombinant DNA molecule coding for the peptide is prepared. Methods of preparing such DNA molecules are well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used.

The invention also includes a vector capable of expressing the peptides in an appropriate host. The vector comprises the DNA molecule that codes for the peptides operatively linked to appropriate expression control sequences. Methods of effecting this operative linking, either before or after the DNA molecule is inserted into the vector, are well known. Expression control sequences include promoters, activators, enhancers, operators, ribosomal binding sites, start signals, stop signals, cap signals, polyadenylation signals, and other signals involved with the control of transcription or translation.

The resulting vector having the DNA molecule thereon is used to transform an appropriate host. This transformation can be performed using methods well known in the art.

Any of a large number of available and well-known host cells can be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts can be equally effective for the expression of a particular DNA sequence. Within these general guidelines, useful microbial hosts include bacteria (such as *E. coli* sp.), yeast (such as *Saccharomyces* sp.) and other fungi, insects, plants, mammalian (including human) cells in culture, or other hosts known in the art.

Next, the transformed host is cultured and purified. Host cells can be cultured under conventional fermentation conditions so that the desired compounds are expressed. Such fermentation conditions are well known in the art. Finally, the peptides are purified from culture by methods well known in the art.

In some embodiments of the inventive DNA, the DNA encodes a recombinant fusion protein composition of the invention, preferably, but not necessarily, monovalent with respect to the toxin peptide, for expression in a mammalian cell, such as, but not limited to, CHO or HEK293. The encoded fusion protein includes (a)-(c) immediately below, in the N-terminal to C-terminal direction:

(a) an immunoglobulin, which includes the constant and variable regions of the immunoglobulin light and heavy chains, or a portion of an immunoglobulin (e.g., an Fc domain, or the variable regions of the light and heavy chains); if both immunoglobulin light chain and heavy chain components are to be included in the construct, then a peptidyl linker, as further described in (b) immediately below, is also included to separate the immunoglobulin components (See, e.g., FIGS. 92A-C); useful coding sequences for immunoglobulin light and heavy chains are well known in the art;

(b) a peptidyl linker, which is at least 4 (or 5) amino acid residues long and comprises at least one protease cleavage site (e.g., a furin cleavage site, which is particularly useful for intracellular cleavage of the expressed fusion protein); typically, the peptidyl linker sequence can be up to about 35 to 45 amino acid residues long (e.g., a 7×L5 linker modified to include the desired protease cleavage site(s)), but linkers up to about 100 to about 300 amino acid residues long are also useful; and (c) an immunoglobulin Fc domain or a portion thereof. The Fc domain of (c) can be from the same type of immunoglobulin in (a), or different. In such embodiments, the DNA encodes a toxin peptide covalently linked to the N-terminal or C-terminal end of (a) or (c) above, either directly or indirectly via a peptidyl linker (a linker minus a protease cleavage site). Any toxin peptide or peptide analog thereof as described herein can be encoded by the DNA (e.g., but not limited to, ShK, HmK, MgTx, AgTx1, AgTx2, HsTx1, OSK1, Anuroctoxin, Noxiustoxin, Hongotoxin, HsTx1, ChTx, MTx, Titystoxin, BgK, BmKTX, BmTx, Tc30, Tc32, Pi1, Pi2, Pi3 toxin peptide, or a peptide analog of any of these). For example, an OSK1 peptide analog comprising an amino acid sequence selected from SEQ ID NOS: 25, 294 through 298, 562 through 636, 980 through 1274, 1303, 1308, 1391 through 4912, 4916, 4920 through 5006, 5009, 5010, and 5012 through 5015, as set forth in Tables 7 and Tables 7A-J, can be employed. Alternatively, an ShK peptide analog comprising an amino acid sequence selected from SEQ ID NOS: 5, 88 through 200, 548 through 561, 884 through 950, and 1295 through 1300 as set forth in Table 2, can be employed. Any other toxin peptide sequence described herein that can alternatively be expressed recombinantly using recombinant and protein engineering techniques known in the art can also be used. The immunoglobulin of (a) and (c) above can be in each instance independently selected from any desired type, such as but not limited to, IgG1, IgG2, IgG3, and IgG4. The variable regions can be non-functional in vivo (e.g., CDRs specifically binding KLH), or alternatively, if targeting enhancement function is also desired, the variable regions can be chosen to specifically bind (non-competitively) the ion channel target of the toxin peptide (e.g., Kv1.3) or specifically bind another antigen typically found associated with, or in the vicinity of, the target ion channel. In addition, the inventive DNA optionally further encodes, 5' to the coding region of (a) above, a signal peptide sequence (e.g., a secretory signal peptide) operably linked to the expressed fusion protein. An example of the inventive DNA encoding a recombinant fusion protein for expression in a mammalian cell, described immediately above, is a DNA that encodes a fusion protein comprising, in the N-terminal to C-terminal direction:

(a) an immunoglobulin light chain;

(b) a first peptidyl linker at least 4 amino acid residues long comprising at least one protease cleavage site, as described above;

(c) an immunoglobulin heavy chain;

(d) a second peptidyl linker at least 4 amino acid residues long comprising at least one protease cleavage site, as described above; and (e) an immunoglobulin Fc domain or a portion thereof. Here, the Fc domain of (e) can be from the same type of immunoglobulin as the heavy chain in (c), or different. The DNA encodes a toxin peptide covalently linked to the N-terminal or C-terminal end of (a), (c), or (e) of the expressed fusion protein, either directly or indirectly via a peptidyl linker (a linker minus a protease cleavage site). FIG. 92A-C illustrates schematically an embodiment, in which the toxin peptide (e.g., an OSK1, ShK, or a peptide analog of either of these) is covalently linked to the C-terminal end of the Fc domain of (e). In FIG. 92A-C, a linker is shown covalently linking the toxin peptide to the rest of the molecule, but as previously described, this linker is optional.

In some embodiments particularly suited for the recombinant expression of monovalent dimeric Fc-toxin peptide fusions or "peptibodies" (see, FIG. 2B and Example 56) by mammalian cells, such as, but not limited to, CHO or HEK293, the inventive DNA encodes a recombinant expressed fusion protein that comprises, in the N-terminal to C-terminal direction:

(a) a first immunoglobulin Fc domain or portion thereof;

(b) a peptidyl linker at least 4 (or 5) amino acid residues long comprising at least one protease cleavage site (e.g., a furin cleavage site, which is particularly useful for intracellular cleavage of the expressed fusion protein); typically, the peptidyl linker sequence can be up to about 35 to 45 amino acid residues long (e.g., a 7×L5 linker modified to include the desired protease cleavage site(s)), but linkers up to about 100 to about 300 amino acid residues long are also useful; and (c) a second immunoglobulin Fc domain or portion thereof (which may be the same or different from the first Fc domain, but should be expressed in the same orientation as the first Fc domain).

For such embodiments, the DNA encodes a toxin peptide covalently linked to the N-terminal or C-terminal end of (a) or (c) of the expressed fusion protein, either directly or indirectly via a peptidyl linker (a linker minus a protease cleavage site); Example 56 describes an embodiment in which the toxin peptide is conjugated to the C-terminal end of the second immunoglobulin Fc domain (c). Any toxin peptide or peptide analog thereof as described herein can be encoded by the DNA (e.g., but not limited to, ShK, HmK, MgTx, AgTx1, AgTx2, HsTx1, OSK1, Anuroctoxin, Noxiustoxin, Hongotoxin, HsTx1, ChTx, MTx, Titystoxin, BgK, BmKTX, BmTx, Tc30, Tc32, Pi1, Pi2, Pi3 toxin peptide, or a peptide analog of any of these). For example, an OSK1 peptide analog comprising an amino acid sequence selected from SEQ ID NOS: 25, 294 through 298, 562 through 636, 980 through 1274, 1303, 1308, 1391 through 4912, 4916, 4920 through 5006, 5009, 5010, and 5012 through 5015, as set forth in Tables 7 and Tables 7A-J, can be employed. Alternatively, an ShK peptide analog comprising an amino acid sequence selected from SEQ ID NOS: 5, 88 through 200, 548 through 561, 884 through 950, and 1295 through 1300 as set forth in Table 2, can be employed. Any other toxin peptide sequence described herein that can alternatively be expressed using recombinant and protein engineering techniques known in the art can also be used. In addition, the inventive DNA optionally further encodes, 5' to the coding region of (a) above, a signal peptide sequence (e.g., a secretory signal peptide) operably linked to the expressed fusion protein.

DNA constructs similar to those described above are also useful for recombinant expression by mammalian cells of other dimeric Fc fusion proteins ("peptibodies") or chimeric immunoglobulin (light chain+heavy chain)-Fc heterotrimers ("hemibodies"), conjugated to pharmacologically active peptides (e.g., agonist or antagonist peptides) other than toxin peptides.

Peptide compositions of the present invention can also be made by synthetic methods. Solid phase synthesis is the preferred technique of making individual peptides since it is the most cost-effective method of making small peptides. For example, well known solid phase synthesis techniques include the use of protecting groups, linkers, and solid phase supports, as well as specific protection and deprotection reaction conditions, linker cleavage conditions, use of scavengers, and other aspects of solid phase peptide synthesis. Suitable techniques are well known in the art. (E.g., Merrifield (1973), *Chem. Polypeptides, pp.* 335-61 (Katsoyannis and Panayotis eds.); Merrifield (1963), *J. Am. Chem. Soc.* 85: 2149; Davis et al. (1985), *Biochem. Intl.* 10: 394-414; Stewart and Young (1969), Solid Phase Peptide Synthesis; U.S. Pat. No. 3,941,763; Finn et al. (1976), *The Proteins* (3rd ed.) 2: 105-253; and Erickson et al. (1976), *The Proteins* (3rd ed.) 2: 257-527; "Protecting Groups in Organic Synthesis," 3rd Edition, T. W. Greene and P. G. M. Wuts, Eds., John Wiley & Sons, Inc., 1999; NovaBiochem Catalog, 2000; "Synthetic Peptides, A User's Guide," G. A. Grant, Ed., W.H. Freeman & Company, New York, N.Y., 1992; "Advanced Chemtech Handbook of Combinatorial & Solid Phase Organic Chemistry," W. D. Bennet, J. W. Christensen, L. K. Hamaker, M. L. Peterson, M. R. Rhodes, and H. H. Saneii, Eds., Advanced Chemtech, 1998; "Principles of Peptide Synthesis, 2nd ed.," M. Bodanszky, Ed., Springer-Verlag, 1993; "The Practice of Peptide Synthesis, 2nd ed.," M. Bodanszky and A. Bodanszky, Eds., Springer-Verlag, 1994; "Protecting Groups," P. J. Kocienski, Ed., Georg Thieme Verlag, Stuttgart, Germany, 1994; "Fmoc Solid Phase Peptide Synthesis, A Practical Approach," W. C. Chan and P. D. White, Eds., Oxford Press, 2000, G. B. Fields et al., Synthetic Peptides: A User's Guide, 1990, 77-183).

Whether the compositions of the present invention are prepared by synthetic or recombinant techniques, suitable protein purification techniques can also be involved, when applicable. In some embodiments of the compositions of the invention, the toxin peptide portion and/or the half-life extending portion, or any other portion, can be prepared to include a suitable isotopic label (e.g., $^{125}I$, $^{14}C$, $^{13}C$, $^{35}S$, $^{3}H$, $^{2}H$, $^{13}N$, $^{15}N$, $^{15}O$, $^{17}O$, etc.), for ease of quantification or detection.

Compounds that contain derivatized peptides or which contain non-peptide groups can be synthesized by well-known organic chemistry techniques.

Uses of the Compounds

In general. The compounds of this invention have pharmacologic activity resulting from their ability to bind to proteins of interest as agonists, mimetics or antagonists of the native ligands of such proteins of interest. Heritable diseases that have a known linkage to ion channels ("channelopathies") cover various fields of medicine, some of which include neurology, nephrology, myology and cardiology. A list of inherited disorders attributed to ion channels includes:

cystic fibrosis ($Cl^-$ channel; CFTR),

Dent's disease (proteinuria and hypercalciuria; $Cl^-$ channel; CLCN5), osteopetrosis ($Cl^-$ channel; CLCN7), familial hyperinsulinemia (SUR1; KCNJ11; K channel), diabetes (KATP/SUR channel), Andersen syndrome (KCNJ2, Kir2.1 K channel), Bartter syndrome (KCNJ1; Kir1.1/ROMK; K channel), hereditary hearing loss (KCNQ4; K channel), hereditary hypertension (Liddle's syndrome; SCNN1; epithelial Na channel), dilated cardiomyopathy (SUR2, K channel), long-QT syndrome or cardiac arrhythmias (cardiac potassium and sodium channels), Thymothy syndrome (CACNA1C, Cav1.2), myasthenic syndromes (CHRNA, CHRNB, CNRNE; nAChR), and a variety of other myopathies, hyperkalemic periodic paralysis (Na and K channels),
epilepsy ($Na^+$ and $K^+$ channels),
hemiplegic migraine (CACNA1A, Cav2.1 $Ca^{2+}$ channel and ATP1A2),
central core disease (RYR1, RYR1; $Ca^{2+}$ channel), and
paramyotonia and myotonia ($Na^+$, $Cl^-$ channels)

See L. J. Ptacek and Y—H Fu (2004), *Arch. Neurol.* 61: 166-8; B. A. Niemeyer et al. (2001), *EMBO reports* 21: 568-73; F. Lehmann-Horn and K. Jurkat-Rott (1999), *Physiol. Rev.* 79: 1317-72. Although the foregoing list concerned disorders of inherited origin, molecules targeting the channels cited in these disorders can also be useful in treating related disorders of other, or indeterminate, origin.

In addition to the aforementioned disorders, evidence has also been provided supporting ion channels as targets for treatment of:

sickle cell anemia (IKCa1)—in sickle cell anemia, water loss from erythrocytes leads to hemoglobin polymerization and subsequent hemolysis and vascular obstruction. The water loss is consequent to potassium efflux through the so-called Gardos channel i.e., IKCa1. Therefore, block of IKCa1 is a potential therapeutic treatment for sickle cell anemia.

glaucoma (BKCa), —in glaucoma the intraocular pressure is too high leading to optic nerve damage, abnormal eye function and possibly blindness. Block of BKCa potassium channels can reduce intraocular fluid secretion and increase smooth muscle contraction, possibly leading to lower intraocular pressure and neuroprotection in the eye.

multiple sclerosis (Kv, KCa),
psoriasis (Kv, KCa),
arthritis (Kv, KCa),
asthma (KCa, Kv),
allergy (KCa, Kv),
COPD (KCa, Kv, Ca),
allergic rhinitis (KCa, Kv),
pulmonary fibrosis,
lupus (IKCa1, Kv),
transplantation, GvHD (KCa, Kv),
inflammatory bone resorption (KCa, Kv),
periodontal disease (KCa, Kv), diabetes, type I (Kv), —type I diabetes is an autoimmune disease that is characterized by abnormal glucose, protein and lipid metabolism and is associated with insulin deficiency or resistance. In this disease, Kv1.3-expressing T-lymphocytes attack and destroy pancreatic islets leading to loss of beta-cells. Block of Kv1.3 decreases inflammatory cytokines. In addition block of Kv1.3 facilitates the translocation of GLUT4 to the plasma membrane, thereby increasing insulin sensitivity.

obesity (Kv), —Kv1.3 appears to play a critical role in controlling energy homeostasis and in protecting against diet-induced obesity. Consequently, Kv1.3 blockers could increase metabolic rate, leading to greater energy utilization and decreased body weight.

restenosis (KCa, $Ca^{2+}$), —proliferation and migration of vascular smooth muscle cells can lead to neointimal thickening and vascular restenosis. Excessive neointimal vascular smooth muscle cell proliferation is associated with elevated expression of IKCa1. Therefore, block of IKCa1 could represent a therapeutic strategy to prevent restenosis after angioplasty.

ischaemia (KCa, $Ca^{2+}$), —in neuronal or cardiac ischemia, depolarization of cell membranes leads to opening of voltage-gated sodium and calcium channels. In turn this can lead to calcium overload, which is cytotoxic. Block of voltage-gated sodium and/or calcium channels can reduce calcium overload and provide cytoprotective effects. In addition, due to their critical role in controlling and stabilizing cell membrane potential, modulators of voltage- and calcium-activated potassium channels can also act to reduce calcium overload and protect cells.

renal incontinence (KCa), renal incontinence is associated with overactive bladder smooth muscle cells. Calcium-activated potassium channels are expressed in bladder smooth muscle cells, where they control the membrane potential and indirectly control the force and frequency of cell contraction. Openers of calcium-activated potassium channels therefore provide a mechanism to dampen electrical and contractile activity in bladder, leading to reduced urge to urinate.

osteoporosis (Kv), pain, including migraine ($Na_v$, TRP [transient receptor potential channels], P2X, $Ca^{2+}$), N-type voltage-gated calcium channels are key regulators of nociceptive neurotransmission in the spinal cord. Ziconotide, a peptide blocker of N-type calcium channels reduces nociceptive neurotransmission and is approved worldwide for the symptomatic alleviation of severe chronic pain in humans. Novel blockers of nociceptor-specific N-type calcium channels would be improved analgesics with reduced side-effect profiles.

hypertension ($Ca^{2+}$), —L-type and T-type voltage-gated calcium channels are expressed in vascular smooth muscle cells where they control excitation-contraction coupling and cellular proliferation. In particular, T-type calcium channel activity has been linked to neointima formation during hypertension. Blockers of L-type and T-type calcium channels are useful for the clinical treatment of hypertension because they reduce calcium influx and inhibit smooth muscle cell contraction.

wound healing, cell migration serves a key role in wound healing. Intracellular calcium gradients have been implicated as important regulators of cellular migration machinery in keratinocytes and fibroblasts. In addition, ion flux across cell membranes is associated with cell volume changes. By controlling cell volume, ion channels contribute to the intracellular environment that is required for operation of the cellular migration machinery. In particular, IKCa1 appears to be required universally for cell migration. In addition, Kv1.3, Kv3.1, NMDA receptors and N-type calcium channels are associated with the migration of lymphocytes and neurons.

stroke,
Alzheimer's,
Parkenson's Disease (nACHR, Nav)
Bipolar Disorder (Nav, Cav)

cancer, many potassium channel genes are amplified and protein subunits are upregulated in many cancerous condition. Consistent with a pathophysiological role for potassium channel upregulation, potassium channel blockers have been shown to suppress proliferation of uterine cancer cells and hepatocarcinoma cells, presumably through inhibition of calcium influx and effects on calcium-dependent gene expression.

a variety of neurological, cardiovascular, metabolic and autoimmune diseases.

Both agonists and antagonists of ion channels can achieve therapeutic benefit. Therapeutic benefits can result, for example, from antagonizing Kv1.3, IKCa1, SKCa, BKCa, N-type or T-type $Ca^{2+}$ channels and the like. Small molecule and peptide antagonists of these channels have been shown to possess utility in vitro and in vivo. Limitations in production efficiency and pharmacokinetics, however, have largely prevented clinical investigation of inhibitor peptides of ion channels.

Compositions of this invention incorporating peptide antagonists of the voltage-gated potassium channel Kv1.3, in particular OSK1 peptide analogs, whether or not conjugated to a half-life extending moiety, are useful as immunosuppressive agents with therapeutic value for autoimmune diseases. For example, such molecules are useful in treating multiple sclerosis, type 1 diabetes, psoriasis, inflammatory bowel disease, and rheumatoid arthritis. (See, e.g., H. Wulff et al. (2003) J. Clin. Invest. 111, 1703-1713 and H. Rus et al. (2005) PNAS 102, 11094-11099; Beeton et al., Targeting effector memory T cells with a selective inhibitor peptide of Kv1.3 channels for therapy of autoimmune diseases, Molec. Pharmacol. 67(4):1369-81 (2005); 1 Beeton et al. (2006), Kv1.3: therapeutic target for cell-mediated autoimmune disease, electronic preprint at //webfiles.uci.edu/xythoswfs/webui/2670029.1). Inhibitors of the voltage-gated potassium channel Kv1.3 have been examined in a variety of preclinical animal models of inflammation. Small molecule and peptide inhibitors of Kv1.3 have been shown to block delayed type hypersensitivity responses to ovalbumin [C. Beeton et al. (2005) Mol. Pharmacol. 67, 1369] and tetanus toxoid [G. C. Koo et al. (1999) Clin. Immunol. 197, 99]. In addition to suppressing inflammation in the skin, inhibitors also reduced antibody production [G. C. Koo et al. (1997) J. Immunol. 158, 5120]. Kv1.3 antagonists have shown efficacy in a rat adoptive-transfer experimental autoimmune encephalomyelitis (AT-EAE) model of multiple sclerosis (MS). The Kv1.3 channel is overexpressed on myelin-specific T cells from MS patients, lending further support to the utility Kv1.3 inhibitors may provide in treating MS. Inflammatory bone resorption was also suppressed by Kv1.3 inhibitors in a preclinical adoptive-transfer model of periodontal disease [P. Valverde et al. (2004) J. Bone Mineral Res. 19, 155]. In this study, inhibitors additionally blocked antibody production to a bacterial outer membrane protein, —one component of the bacteria used to induce gingival inflammation. Recently in preclinical rat models, efficacy of Kv1.3 inhibitors was shown in treating pristane-induced arthritis and diabetes [C. Beeton et al. (2006) preprint available at //webfiles.uci.edu/xythoswfs/webui/_xy-2670029__1.]. The Kv1.3 channel is expressed on all subsets of T cells and B cells, but effector memory T cells and class-switched memory B cells are particularly dependent on Kv1.3 [H. Wulff et al. (2004) J. Immunol. 173, 776]. Gad5/insulin-specific T cells from patients with new onset type 1 diabetes, myelin-specific T cells from MS patients and T cells from the synovium of rheumatoid arthritis patients all overexpress Kv1.3 [C. Beeton et al. (2006) preprint at //webfiles.uci.edu/xythoswfs/webui/_xy-2670029__1.]. Because mice deficient in Kv1.3 gained less weight when placed on a high fat diet [J. Xu et al. (2003) Human Mol. Genet. 12, 551] and showed altered glucose utilization [J. Xu et al. (2004) Proc. Natl. Acad. Sci. 101, 3112], Kv1.3 is also being investigated for the treatment of obesity and diabetes. Breast cancer specimens [M. Abdul et al. (2003) Anticancer Res. 23, 3347] and prostate cancer cell lines [S. P. Fraser et al. (2003) Pflugers Arch. 446, 559] have also been shown to express Kv1.3, and Kv1.3 blockade may be of utility for treatment of cancer. Disorders that can be treated in accordance with the inventive method of treating an autoimmune disorder, involving Kv1.3 inhibitor toxin peptide(s), include multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and systemic lupus erythematosus (SLE) and other forms of lupus.

Some of the cells that express the calcium-activated potassium of intermediate conductance IKCa1 include T cells, B cells, mast cells and red blood cells (RBCs). T cells and RBCs from mice deficient in IKCa1 show defects in volume regulation [T. Begenisich et al. (2004) J. Biol. Chem. 279, 47681]. Preclinical and clinical studies have demonstrated IKCa1 inhibitors utility in treating sickle cell anemia [J. W. Stocker et al. (2003) Blood 101, 2412]. Blockers of the IKCa1 channel have also been shown to block EAE, indicating they may possess utility in treatment of MS [E. P. Reich et al. (2005) Eur. J. Immunol. 35, 1027]. IgE-mediated histamine production from mast cells is also blocked by IKCa1 inhibitors [S. Mark Duffy et al. (2004) J. Allergy Clin. Immunol. 114, 66], therefore they may also be of benefit in treating asthma. The IKCa1 channel is overexpressed on activated T and B lymphocytes [H. Wulff et al. (2004) J. Immunol. 173, 776] and thus may show utility in treatment of a wide variety of immune disorders. Outside of the immune system, IKCa1 inhibitors have also shown efficacy in a rat model of vascular restinosis and thus might represent a new therapeutic strategy to prevent restenosis after angioplasty [R. Kohler et al. (2003) Circulation 108, 1119]. It is also thought that IKCa1 antagonists are of utility in treatment of tumor angiogenesis since inhibitors suppressed endothelial cell proliferation and angionenesis in vivo [I. Grgic et al. (2005) Arterioscler. Thromb. Vasc. Biol. 25, 704]. The IKCa1 channel is upregulated in pancreatic tumors and inhibitors blocked proliferation of pancreatic tumor cell lines [H. Jager et al. (2004) Mol Pharmacol. 65, 630]. IKCa1 antagonists may also represent an approach to attenuate acute brain damage caused by traumatic brain injury [F. Mauler (2004) Eur. J. Neurosci. 20, 1761]. Disorders that can be treated with IKCa1 inhibitors include multiple sclerosis, asthma, psoriasis, contact-mediated dermatitis, rheumatoid & psoriatic arthritis, inflammatory bowel disease, transplant rejection, graft-versus-host disease, Lupus, restinosis, pancreatic cancer, tumor angiogenesis and traumatic brain injury.

Accordingly, molecules of this invention incorporating peptide antagonists of the calcium-activated potassium channel of intermediate conductance, IKCa can be used to treat immune dysfunction, multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and lupus.

Accordingly, the present invention includes a method of treating an autoimmune disorder, which involves administering to a patient who has been diagnosed with an autoimmune disorder, such as multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, a therapeutically effective amount of the inventive composition of matter, whereby at least one symptom of the disorder is alleviated in the patient. "Alleviated" means to be lessened, lightened, diminished, softened, mitigated (i.e., made more mild or gentle), quieted, assuaged, abated, relieved, nullified, or allayed, regardless of whether the symptom of interest is entirely erased, eradicated, eliminated, or prevented in a particular patient.

The present invention is further directed to a method of preventing or mitigating a relapse of a symptom of multiple sclerosis, which method involves administering to a patient, who has previously experienced at least one symptom of multiple sclerosis, a prophylactically effective amount of the inventive composition of matter, such that the at least one symptom of multiple sclerosis is prevented from recurring or is mitigated.

The inventive compositions of matter preferred for use in practicing the inventive method of treating an autoimmune disorder, e.g., inflammatory bowel disease (IBD, including Crohn's Disease and ulcerative colitis), and the method of preventing or mitigating a relapse of a symptom of multiple sclerosis include as P (conjugated as in Formula I), a Kv1.3 or IKCa1 antagonist peptide, such as a ShK peptide, an OSK1 peptide or an OSK1 peptide analog, a ChTx peptide and/or a Maurotoxin (MTx) peptide, or peptide analogs of any of these.

For example, the conjugated ShK peptide or ShK peptide analog can comprise an amino acid sequence selected from the following:

SEQ ID NOS: 5, 88 through 200, 548 through 561, 884 through 950, or 1295 through 1300 as set forth in Table 2.

The conjugated OSK1 peptide, or conjugated or unconjugated OSK1 peptide analog, can comprise an amino acid sequence selected from the following:

SEQ ID NOS: 25, 294 through 298, 562 through 636, 980 through 1274, GVIINVSCKISRQCLEPCKKAGMRFGKCMNGKCHCTPK (OSK1-S7) (SEQ ID NO: 1303), or GVIINVSCKISRQCLKPCKDAGMRFGKCMNGKCHCTPK (OSK1-S7,K16,D20) (SEQ ID NO: 1308) as set forth in Table 7, or any of SEQ ID NOS: 1391 through 4912, 4916, 4920 through 5006, 5009, 5010, and 5012 through 5015 as set forth in Table 7A, Table 7B, Table 7C, Table 7D, Table 7E, Table 7F, Table 7G, Table 7H, Table 7I, or Table 7J.

Also by way of example, a the conjugated MTX peptide, MTX peptide analog, ChTx peptide or ChTx peptide analog can comprise an amino acid sequence selected from:

SEQ ID NOS: 20, 330 through 343, 1301, 1302, 1304 through 1307, 1309, 1311, 1312, or 1315 through 1336 as set forth in Table 13; or SEQ ID NOS: 36, 59, 344 through 346, or 1369 through 1390 as set forth in Table 14.

Also useful in these methods conjugated, or unconjugated, are a Kv1.3 or IKCa1 inhibitor toxin peptide analog that comprises an amino acid sequence selected from:

SEQ ID NOS: 88, 89, 92, 148 through 200, 548 through 561, 884 through 949, or 1295 through 1300 as set forth in Table 2; or SEQ ID NOS: 980 through 1274, GVIINVSCKISRQCLEPCKKAGMRFGKCMNGKCHCTPK (OSK1-S7) (SEQ ID NO: 1303), or GVIINVSCKISRQCLKPCKDAGMRFGKCMNGKCHCTPK (OSK1-S7,K16,D20) (SEQ ID NO: 1308) as set forth in Table 7; or SEQ ID NOS: 330 through 337, 341, 1301, 1302, 1304 through 1307, 1309, 1311, 1312, and 1315 through 1336 as set forth in Table 13.

In accordance with these inventive methods, a patient who has been diagnosed with an autoimmune disorder, such as, but not limited to multiple sclerosis, type 1 diabetes, psoriasis, inflammatory bowel disease, contact-mediated dermatitis, rheumatoid arthritis, psoratic arthritis, asthma, allergy, restinosis, systemic sclerosis, fibrosis, scleroderma, glomerulonephritis, Sjogren syndrome, inflammatory bone resorption, transplant rejection, graft-versus-host disease, or lupus, or a patient who has previously experienced at least one symptom of multiple sclerosis, are well-recognizable and/or diagnosed by the skilled practitioner, such as a physician, familiar with autoimmune disorders and their symptoms.

For example, symptoms of multiple sclerosis can include the following: visual symptoms, such as, optic neuritis (blurred vision, eye pain, loss of color vision, blindness); diplopia (double vision); nystagmus (jerky eye movements); ocular dysmetria (constant under- or overshooting eye movements); internuclear opthalmoplegia (lack of coordination between the two eyes, nystagmus, diplopia); movement and sound phosphenes (flashing lights when moving eyes or in response to a sudden noise); afferent pupillary defect (abnormal pupil responses);

motor symptoms, such as, paresis, monoparesis, paraparesis, hemiparesis, quadraparesis (muscle weakness—partial or mild paralysis); plegia, paraplegia, hemiplegia, tetraplegia, quadraplegia (paralysis—total or near total loss of muscle strength); spasticity (loss of muscle tone causing stiffness, pain and restricting free movement of affected limbs); dysarthria (slurred speech and related speech problems); muscle atrophy (wasting of muscles due to lack of use); spasms, cramps (involuntary contraction of muscles); hypotonia, clonus (problems with posture); myoclonus, myokymia (jerking and twitching muscles, tics); restless leg syndrome (involuntary leg movements, especially bothersome at night); footdrop (foot drags along floor during walking); dysfunctional reflexes (MSRs, Babinski's, Hoffman's, Chaddock's);

sensory symptoms, such as, paraesthesia (partial numbness, tingling, buzzing and vibration sensations); anaesthesia (complete numbness/loss of sensation); neuralgia, neuropathic and neurogenic pain (pain without apparent cause, burning, itching and electrical shock sensations); L'Hermitte's (electric shocks and buzzing sensations when moving head); proprioceptive dysfunction (loss of awareness of location of body parts); trigeminal neuralgia (facial pain);

coordination and balance symptoms, such as, ataxia (loss of coordination); intention tremor (shaking when performing fine movements); dysmetria (constant under- or overshooting limb movements); vestibular ataxia (abnormal balance function in the inner ear); vertigo (nausea/vomitting/sensitivity to travel sickness from vestibular ataxia); speech ataxia (problems coordinating speech, stuttering); dystonia (slow limb position feedback); dysdiadochokinesia (loss of ability to produce rapidly alternating movements, for example to move to a rhythm);

bowel, bladder and sexual symptoms, such as, frequent micturation, bladder spasticity (urinary urgency and incontinence); flaccid bladder, detrusor-sphincter dyssynergia (urinary hesitancy and retention); erectile dysfunction (male and female impotence); anorgasmy (inability to achieve orgasm); retrograde ejaculation (ejaculating into the bladder); frigidity (inability to become sexually aroused); constipation (infrequent or irregular bowel movements); fecal urgency (bowel urgency); fecal incontinence (bowel incontinence);

cognitive symptoms, such as, depression; cognitive dysfunction (short-term and long-term memory problems, forgetfulness, slow word recall); dementia; mood swings, emotional lability, euphoria; bipolar syndrome;

anxiety; aphasia, dysphasia (impairments to speech comprehension and production); and other symptoms, such as, fatigue; Uhthoff's Symptom (increase in severity of symptoms with heat); gastroesophageal reflux (acid reflux); impaired sense of taste and smell; epileptic seizures; swallowing problems, respiratory problems; and sleeping disorders.

By way of further example, symptoms of inflammatory bowel disease can include the following symptoms of Crohn's Disease or ulcerative colitis:

A. Symptoms of Crohn's disease can include:

Abdominal pain. The pain often is described as cramping and intermittent, and the abdomen may be sore when touched. Abdominal pain may turn to a dull, constant ache as the condition progresses.

Diarrhea. Some patients may have diarrhea 10 to 20 times per day. They may wake up at night and need to go to the bathroom. Crohn's disease may cause blood in stools, but not always.

Loss of appetite.

Fever. In severe cases, fever or other symptoms that affect the entire body may develop. A high fever may indicate a complication involving infection, such as an abscess.

Weight loss. Ongoing symptoms, such as diarrhea, can lead to weight loss. Too few red blood cells (anemia). Some patients with Crohn's disease develop anemia because of low iron levels caused by bloody stools or the intestinal inflammation itself.

B. The symptoms of ulcerative colitis may include:

Diarrhea or rectal urgency. Some patients may have diarrhea 10 to 20 times per day. The urge to defecate may wake patients at night.

Rectal bleeding. Ulcerative colitis usually causes bloody diarrhea and mucus. Patients also may have rectal pain and an urgent need to empty the bowels.

Abdominal pain, often described as cramping. The patient's abdomen may be sore when touched.

Constipation. This symptom may develop depending on what part of the colon is affected.

Loss of appetite.

Fever. In severe cases, fever or other symptoms that affect the entire body may develop.

Weight loss. Ongoing (chronic) symptoms, such as diarrhea, can lead to weight loss.

Too few red blood cells (anemia). Some patients develop anemia because of low iron levels caused by bloody stools or intestinal inflammation.

The symptoms of multiple sclerosis and inflammatory bowel disease (including Crohn's Disease and ulcerative colitis) enumerated above, are merely illustrative and are not intended to be an exhaustive description of all possible symptoms experienced by a single patient or by several sufferers in composite, and to which the present invention is directed. Those skilled in the art are aware of various clinical symptoms and constellations of symptoms of autoimmune disorders suffered by individual patients, and to those symptoms are also directed the present inventive methods of treating an autoimmune disorder or of preventing or mitigating a relapse of a symptom of multiple sclerosis.

The therapeutically effective amount, prophylactically effective amount, and dosage regimen involved in the inventive methods of treating an autoimmune disorder or of preventing or mitigating a relapse of a symptom of multiple sclerosis, will be determined by the attending physician, considering various factors which modify the action of therapeutic agents, such as the age, condition, body weight, sex and diet of the patient, the severity of the condition being treated, time of administration, and other clinical factors. Generally, the daily amount or regimen should be in the range of about 1 to about 10,000 micrograms (μg) of the vehicle-conjugated peptide per kilogram (kg) of body mass, preferably about 1 to about 5000 μg per kilogram of body mass, and most preferably about 1 to about 1000 μg per kilogram of body mass.

Molecules of this invention incorporating peptide antagonists of the voltage-gated potassium channel Kv2.1 can be used to treat type II diabetes.

Molecules of this invention incorporating peptide antagonists of the M current (e.g., BeKm-1) can be used to treat Alzheimer's disease and enhance cognition.

Molecules of this invention incorporating peptide antagonists of the voltage-gated potassium channel Kv4.3 can be used to treat Alzheimer's disease.

Molecules of this invention incorporating peptide antagonists of the calcium-activated potassium channel of small conductance, SKCa can be used to treat epilepsy, memory, learning, neuropsychiatric, neurological, neuromuscular, and immunological disorders, schizophrenia, bipolar disorder, sleep apnea, neurodegeneration, and smooth muscle disorders.

Molecules of this invention incorporating N-type calcium channel antagonist peptides are useful in alleviating pain. Peptides with such activity (e.g., Ziconotide™, ω-conotoxin-MVIIA) have been clinically validated.

Molecules of this invention incorporating T-type calcium channel antagonist peptides are useful in alleviating pain. Several lines of evidence have converged to indicate that inhibition of Cav3.2 in dorsal root ganglia may bring relief from chronic pain. T-type calcium channels are found at extremely high levels in the cell bodies of a subset of neurons in the DRG; these are likely mechanoreceptors adapted to detect slowly-moving stimuli (Shin et al., Nature Neuroscience 6:724-730, 2003), and T-type channel activity is likely responsible for burst spiking (Nelson et al., J Neurosci 25:8766-8775, 2005). Inhibition of T-type channels by either mibefradil or ethosuximide reverses mechanical allodynia in animals induced by nerve injury (Dogrul et al., Pain 105:159-168, 2003) or by chemotherapy (Flatters and Bennett, Pain 109:150-161, 2004). Antisense to Cav3.2, but not Cav3.1 or Cav3.3, increases pain thresholds in animals and also reduces expression of Cav3.2 protein in the DRG (Bourinet et al., EMBO J 24:315-324, 2005). Similarly, locally injected reducing agents produce pain and increase Cav3.2 currents, oxidizing agents reduce pain and inhibit Cav3.2 currents, and peripherally administered neurosteroids are analgesic and inhibit T-type currents from DRG (Todorovic et al., Pain 109:328-339, 2004; Pathirathna et al., Pain 114:429-443, 2005). Accordingly, it is thought that inhibition of Cav3.2 in the cell bodies of DRG neurons can inhibit the repetitive spiking of these neurons associated with chronic pain states.

Molecules of this invention incorporating L-type calcium channel antagonist peptides are useful in treating hypertension. Small molecules with such activity (e.g., DHP) have been clinically validated.

Molecules of this invention incorporating peptide antagonists of the $Na_V1$ ($TTX_S$-type) channel can be used to alleviate pain. Local anesthetics and tricyclic antidepressants with such activity have been clinically validated. Such molecules of this invention can in particular be useful as muscle relaxants.

Molecules of this invention incorporating peptide antagonists of the $Na_V1$ ($TTX_R$-type) channel can be used to alleviate pain arising from nerve and or tissue injury.

Molecules of this invention incorporating peptide antagonists of glial & epithelial cell $Ca^{2+}$-activated chloride channel can be used to treat cancer and diabetes.

Molecules of this invention incorporating peptide antagonists of NMDA receptors can be used to treat pain, epilepsy, brain and spinal cord injury.

Molecules of this invention incorporating peptide antagonists of nicotinic receptors can be used as muscle relaxants. Such molecules can be used to treat pain, gastric motility disorders, urinary incontinence, nicotine addiction, and mood disorders.

Molecules of this invention incorporating peptide antagonists of 5HT3 receptor can be used to treat Nausea, pain, and anxiety.

Molecules of this invention incorporating peptide antagonists of the norepinephrine transporter can be used to treat pain, anti-depressant, learning, memory, and urinary incontinence.

Molecules of this invention incorporating peptide antagonists of the Neurotensin receptor can be used to treat pain.

In addition to therapeutic uses, the compounds of the present invention can be useful in diagnosing diseases characterized by dysfunction of their associated protein of interest. In one embodiment, a method of detecting in a biological sample a protein of interest (e.g., a receptor) that is capable of being activated comprising the steps of: (a) contacting the sample with a compound of this invention; and (b) detecting activation of the protein of interest by the compound. The biological samples include tissue specimens, intact cells, or extracts thereof. The compounds of this invention can be used as part of a diagnostic kit to detect the presence of their associated proteins of interest in a biological sample. Such kits employ the compounds of the invention having an attached label to allow for detection. The compounds are useful for identifying normal or abnormal proteins of interest.

The therapeutic methods, compositions and compounds of the present invention can also be employed, alone or in combination with other molecules in the treatment of disease.

Pharmaceutical Compositions

In General. The present invention also provides pharmaceutical compositions comprising the inventive composition of matter and a pharmaceutically acceptable carrier. Such pharmaceutical compositions can be configured for administration to a patient by a wide variety of delivery routes, e.g., an intravascular delivery route such as by injection or infusion, subcutaneous, intramuscular, intraperitoneal, epidural, or intrathecal delivery routes, or for oral, enteral, pulmonary (e.g., inhalant), intranasal, transmucosal (e.g., sublingual administration), transdermal or other delivery routes and/or forms of administration known in the art. The inventive pharmaceutical compositions may be prepared in liquid form, or may be in dried powder form, such as lyophilized form. For oral or enteral use, the pharmaceutical compositions can be configured, for example, as tablets, troches, lozenges, aqueous or oily suspensions, dispersible powders or granules, emulsions, hard or soft capsules, syrups, elixirs or enteral formulas.

In the practice of this invention the "pharmaceutically acceptable carrier" is any physiologically tolerated substance known to those of ordinary skill in the art useful in formulating pharmaceutical compositions, including, any pharmaceutically acceptable diluents, excipients, dispersants, binders, fillers, glidants, anti-frictional agents, compression aids, tablet-disintegrating agents (disintegrants), suspending agents, lubricants, flavorants, odorants, sweeteners, permeation or penetration enhancers, preservatives, surfactants, solubilizers, emulsifiers, thickeners, adjuvants, dyes, coatings, encapsulating material(s), and/or other additives singly or in combination. Such pharmaceutical compositions can include diluents of various buffer content (e.g., Tris-HCl, acetate, phosphate), pH and ionic strength; additives such as detergents and solubilizing agents (e.g., Tween® 80, Polysorbate 80), anti-oxidants (e.g., ascorbic acid, sodium metabisulfite), preservatives (e.g., Thimersol®, benzyl alcohol) and bulking substances (e.g., lactose, mannitol); incorporation of the material into particulate preparations of polymeric compounds such as polylactic acid, polyglycolic acid, etc. or into liposomes. Hyaluronic acid can also be used, and this can have the effect of promoting sustained duration in the circulation. Such compositions can influence the physical state, stability, rate of in vivo release, and rate of in vivo clearance of the present proteins and derivatives. See, e.g., *Remington's Pharmaceutical Sciences,* 18th Ed. (1990, Mack Publishing Co., Easton, Pa. 18042) pages 1435-1712, which are herein incorporated by reference in their entirety. The compositions can be prepared in liquid form, or can be in dried powder, such as lyophilized form. Implantable sustained release formulations are also useful, as are transdermal or transmucosal formulations. Additionally (or alternatively), the present invention provides compositions for use in any of the various slow or sustained release formulations or microparticle formulations known to the skilled artisan, for example, sustained release microparticle formulations, which can be administered via pulmonary, intranasal, or subcutaneous delivery routes.

One can dilute the inventive compositions or increase the volume of the pharmaceutical compositions of the invention with an inert material. Such diluents can include carbohydrates, especially, mannitol, α-lactose, anhydrous lactose, cellulose, sucrose, modified dextrans and starch. Certain inorganic salts may also be used as fillers, including calcium triphosphate, magnesium carbonate and sodium chloride. Some commercially available diluents are Fast-Flo, Emdex, STA-Rx 1500, Emcompress and Avicell.

A variety of conventional thickeners are useful in creams, ointments, suppository and gel configurations of the pharmaceutical composition, such as, but not limited to, alginate, xanthan gum, or petrolatum, may also be employed in such configurations of the pharmaceutical composition of the present invention. A permeation or penetration enhancer, such as polyethylene glycol monolaurate, dimethyl sulfoxide, N-vinyl-2-pyrrolidone, N-(2-hydroxyethyl)-pyrrolidone, or 3-hydroxy-N-methyl-2-pyrrolidone can also be employed. Useful techniques for producing hydrogel matrices are known. (E.g., Feijen, Biodegradable hydrogel matrices for the controlled release of pharmacologically active agents, U.S. Pat. No. 4,925,677; Shah et al., Biodegradable pH/thermosensitive hydrogels for sustained delivery of biologically active agents, WO 00/38651 A1). Such biodegradable gel matrices can be formed, for example, by crosslinking a proteinaceous component and a polysaccharide or mucopolysaccharide component, then loading with the inventive composition of matter to be delivered.

Liquid pharmaceutical compositions of the present invention that are sterile solutions or suspensions can be administered to a patient by injection, for example, intramuscularly, intrathecally, epidurally, intravascularly (e.g., intravenously or intraarterially), intraperitoneally or subcutaneously. (See, e.g., Goldenberg et al., Suspensions for the sustained release of proteins, U.S. Pat. No. 6,245,740 and WO 00/38652 A1). Sterile solutions can also be administered by intravenous infusion. The inventive composition can be included in a sterile solid pharmaceutical composition, such as a lyophilized powder, which can be dissolved or suspended at a convenient time before administration to a patient using sterile water, saline, buffered saline or other appropriate sterile injectable medium.

Implantable sustained release formulations are also useful embodiments of the inventive pharmaceutical compositions. For example, the pharmaceutically acceptable carrier, being a biodegradable matrix implanted within the body or under the skin of a human or non-human vertebrate, can be a hydrogel similar to those described above. Alternatively, it may be formed from a poly-alpha-amino acid component. (Sidman, Biodegradable, implantable drug delivery device, and process for preparing and using same, U.S. Pat. No. 4,351,337). Other techniques for making implants for delivery of drugs are also known and useful in accordance with the present invention.

In powder forms, the pharmaceutically acceptable carrier is a finely divided solid, which is in admixture with finely divided active ingredient(s), including the inventive composition. For example, in some embodiments, a powder form is useful when the pharmaceutical composition is configured as an inhalant. (See, e.g., Zeng et al., Method of preparing dry powder inhalation compositions, WO 2004/017918; Trunk et al., Salts of the CGRP antagonist BIBN4096 and inhalable powdered medicaments containing them, U.S. Pat. No. 6,900, 317).

One can dilute or increase the volume of the compound of the invention with an inert material. These diluents could include carbohydrates, especially mannitol, α-lactose, anhydrous lactose, cellulose, sucrose, modified dextrans and starch. Certain inorganic salts can also be used as fillers including calcium triphosphate, magnesium carbonate and sodium chloride. Some commercially available diluents are Fast-Flo™, Emdex™, STA-Rx™ 1500, Emcompress™ and Avicell™.

Disintegrants can be included in the formulation of the pharmaceutical composition into a solid dosage form. Materials used as disintegrants include but are not limited to starch including the commercial disintegrant based on starch, Explotab™. Sodium starch glycolate, Amberlite™, sodium carboxymethylcellulose, ultramylopectin, sodium alginate, gelatin, orange peel, acid carboxymethyl cellulose, natural sponge and bentonite can all be used. Insoluble cationic exchange resin is another form of disintegrant. Powdered gums can be used as disintegrants and as binders and these can include powdered gums such as agar, Karaya or tragacanth. Alginic acid and its sodium salt are also useful as disintegrants.

Binders can be used to hold the therapeutic agent together to form a hard tablet and include materials from natural products such as acacia, tragacanth, starch and gelatin. Others include methyl cellulose (MC), ethyl cellulose (EC) and carboxymethyl cellulose (CMC). Polyvinyl pyrrolidone (PVP) and hydroxypropylmethyl cellulose (HPMC) could both be used in alcoholic solutions to granulate the therapeutic.

An antifrictional agent can be included in the formulation of the therapeutic to prevent sticking during the formulation process. Lubricants can be used as a layer between the therapeutic and the die wall, and these can include but are not limited to; stearic acid including its magnesium and calcium salts, polytetrafluoroethylene (PTFE), liquid paraffin, vegetable oils and waxes. Soluble lubricants can also be used such as sodium lauryl sulfate, magnesium lauryl sulfate, polyethylene glycol of various molecular weights, Carbowax 4000 and 6000.

Glidants that might improve the flow properties of the drug during formulation and to aid rearrangement during compression might be added. The glidants can include starch, talc, pyrogenic silica and hydrated silicoaluminate.

To aid dissolution of the compound of this invention into the aqueous environment a surfactant might be added as a wetting agent. Surfactants can include anionic detergents such as sodium lauryl sulfate, dioctyl sodium sulfosuccinate and dioctyl sodium sulfonate. Cationic detergents might be used and could include benzalkonium chloride or benzethonium chloride. The list of potential nonionic detergents that could be included in the formulation as surfactants are lauromacrogol 400, polyoxyl 40 stearate, polyoxyethylene hydrogenated castor oil 10, 50 and 60, glycerol monostearate, polysorbate 40, 60, 65 and 80, sucrose fatty acid ester, methyl cellulose and carboxymethyl cellulose. These surfactants could be present in the formulation of the protein or derivative either alone or as a mixture in different ratios.

Oral dosage forms. Also useful are oral dosage forms of the inventive compositions. If necessary, the composition can be chemically modified so that oral delivery is efficacious. Generally, the chemical modification contemplated is the attachment of at least one moiety to the molecule itself, where said moiety permits (a) inhibition of proteolysis; and (b) uptake into the blood stream from the stomach or intestine. Also desired is the increase in overall stability of the compound and increase in circulation time in the body. Moieties useful as covalently attached half-life extending moieties in this invention can also be used for this purpose. Examples of such moieties include: PEG, copolymers of ethylene glycol and propylene glycol, carboxymethyl cellulose, dextran, polyvinyl alcohol, polyvinyl pyrrolidone and polyproline. See, for example, Abuchowski and Davis (1981), *Soluble Polymer-Enzyme Adducts, Enzymes as Drugs* (Hocenberg and Roberts, eds.), Wiley-Interscience, New York, N.Y., pp 367-83; Newmark, et al. (1982), *J. Appl. Biochem.* 4:185-9. Other polymers that could be used are poly-1,3-dioxolane and poly-1,3,6-tioxocane. Preferred for pharmaceutical usage, as indicated above, are PEG moieties.

For oral delivery dosage forms, it is also possible to use a salt of a modified aliphatic amino acid, such as sodium N-(8-[2-hydroxybenzoyl]amino) caprylate (SNAC), as a carrier to enhance absorption of the therapeutic compounds of this invention. The clinical efficacy of a heparin formulation using SNAC has been demonstrated in a Phase II trial conducted by Emisphere Technologies. See U.S. Pat. No. 5,792,451, "Oral drug delivery composition and methods."

In one embodiment, the pharmaceutically acceptable carrier can be a liquid and the pharmaceutical composition is prepared in the form of a solution, suspension, emulsion, syrup, elixir or pressurized composition. The active ingredient(s) (e.g., the inventive composition of matter) can be dissolved, diluted or suspended in a pharmaceutically acceptable liquid carrier such as water, an organic solvent, a mixture of both, or pharmaceutically acceptable oils or fats. The liquid carrier can contain other suitable pharmaceutical additives such as detergents and/or solubilizers (e.g., Tween 80, Polysorbate 80), emulsifiers, buffers at appropriate pH (e.g., Tris-HCl, acetate, phosphate), adjuvants, anti-oxidants (e.g., ascorbic acid, sodium metabisulfite), preservatives (e.g., Thimersol, benzyl alcohol), sweeteners, flavoring agents, suspending agents, thickening agents, bulking substances (e.g., lactose, mannitol), colors, viscosity regulators, stabilizers, electrolytes, osmolutes or osmo-regulators. Additives can also be included in the formulation to enhance uptake of the inventive composition. Additives potentially having this property are for instance the fatty acids oleic acid, linoleic acid and linolenic acid.

Useful are oral solid dosage forms, which are described generally in *Remington's Pharmaceutical Sciences* (1990), supra, in Chapter 89, which is hereby incorporated by reference in its entirety. Solid dosage forms include tablets, capsules, pills, troches or lozenges, cachets or pellets. Also, liposomal or proteinoid encapsulation can be used to formulate the present compositions (as, for example, proteinoid microspheres reported in U.S. Pat. No. 4,925,673). Liposomal encapsulation can be used and the liposomes can be derivatized with various polymers (e.g., U.S. Pat. No. 5,013,556). A description of possible solid dosage forms for the therapeutic is given in Marshall, K., *Modern Pharmaceutics* (1979), edited by G. S. Banker and C. T. Rhodes, in Chapter 10, which is hereby incorporated by reference in its entirety. In general, the formulation will include the inventive compound, and inert ingredients that allow for protection against the stomach environment, and release of the biologically active material in the intestine.

The composition of this invention can be included in the formulation as fine multiparticulates in the form of granules or pellets of particle size about 1 mm. The formulation of the material for capsule administration could also be as a powder, lightly compressed plugs or even as tablets. The therapeutic could be prepared by compression.

Colorants and flavoring agents can all be included. For example, the protein (or derivative) can be formulated (such as by liposome or microsphere encapsulation) and then further contained within an edible product, such as a refrigerated beverage containing colorants and flavoring agents.

In tablet form, the active ingredient(s) are mixed with a pharmaceutically acceptable carrier having the necessary compression properties in suitable proportions and compacted in the shape and size desired.

The powders and tablets preferably contain up to 99% of the active ingredient(s). Suitable solid carriers include, for example, calcium phosphate, magnesium stearate, talc, sugars, lactose, dextrin, starch, gelatin, cellulose, polyvinylpyrrolidine, low melting waxes and ion exchange resins.

Controlled release formulation can be desirable. The composition of this invention could be incorporated into an inert matrix that permits release by either diffusion or leaching mechanisms e.g., gums. Slowly degenerating matrices can also be incorporated into the formulation, e.g., alginates, polysaccharides. Another form of a controlled release of the compositions of this invention is by a method based on the Oros™ therapeutic system (Alza Corp.), i.e., the drug is enclosed in a semipermeable membrane which allows water to enter and push drug out through a single small opening due to osmotic effects. Some enteric coatings also have a delayed release effect.

Other coatings can be used for the formulation. These include a variety of sugars that could be applied in a coating pan. The therapeutic agent could also be given in a film-coated tablet and the materials used in this instance are divided into 2 groups. The first are the nonenteric materials and include methylcellulose, ethyl cellulose, hydroxyethyl cellulose, methylhydroxy-ethyl cellulose, hydroxypropyl cellulose, hydroxypropyl-methyl cellulose, sodium carboxymethyl cellulose, providone and the polyethylene glycols. The second group consists of the enteric materials that are commonly esters of phthalic acid.

A mix of materials might be used to provide the optimum film coating. Film coating can be carried out in a pan coater or in a fluidized bed or by compression coating.

Pulmonary delivery forms. Pulmonary delivery of the inventive compositions is also useful. The protein (or derivative) is delivered to the lungs of a mammal while inhaling and traverses across the lung epithelial lining to the blood stream. (Other reports of this include Adjei et al., *Pharma. Res.* (1990) 7: 565-9; Adjei et al. (1990), *Internatl. J. Pharmaceutics* 63: 135-44 (leuprolide acetate); Braquet et al. (1989), *J. Cardiovasc. Pharmacol.* 13 (suppl.5): s.143-146 (endothelin-1); Hubbard et al. (1989), *Annals Int. Med.* 3: 206-12 (α1-antitrypsin); Smith et al. (1989), *J. Clin. Invest.* 84: 1145-6 (α1-proteinase); Oswein et al. (March 1990), "Aerosolization of Proteins," *Proc. Symp. Resp. Drug Delivery II*, Keystone, Colo. (recombinant human growth hormone); Debs et al. (1988), *J. Immunol.* 140: 3482-8 (interferon-γ and tumor necrosis factor α) and Platz et al., U.S. Pat. No. 5,284,656 (granulocyte colony stimulating factor).

Useful in the practice of this invention are a wide range of mechanical devices designed for pulmonary delivery of therapeutic products, including but not limited to nebulizers, metered dose inhalers, and powder inhalers, all of which are familiar to those skilled in the art. Some specific examples of commercially available devices suitable for the practice of this invention are the Ultravent nebulizer, manufactured by Mallinckrodt, Inc., St. Louis, Mo.; the Acorn II nebulizer, manufactured by Marquest Medical Products, Englewood, Colo.; the Ventolin metered dose inhaler, manufactured by Glaxo Inc., Research Triangle Park, N.C.; and the Spinhaler powder inhaler, manufactured by Fisons Corp., Bedford, Mass. (See, e.g., Helgesson et al., Inhalation device, U.S. Pat. No. 6,892,728; McDerment et al., Dry powder inhaler, WO 02/11801 A1; Ohki et al., Inhalant medicator, U.S. Pat. No. 6,273,086).

All such devices require the use of formulations suitable for the dispensing of the inventive compound. Typically, each formulation is specific to the type of device employed and can involve the use of an appropriate propellant material, in addition to diluents, adjuvants and/or carriers useful in therapy.

The inventive compound should most advantageously be prepared in particulate form with an average particle size of less than 10 μm (or microns), most preferably 0.5 to 5 μm, for most effective delivery to the distal lung.

Pharmaceutically acceptable carriers include carbohydrates such as trehalose, mannitol, xylitol, sucrose, lactose, and sorbitol. Other ingredients for use in formulations can include DPPC, DOPE, DSPC and DOPC. Natural or synthetic surfactants can be used. PEG can be used (even apart from its use in derivatizing the protein or analog). Dextrans, such as cyclodextran, can be used. Bile salts and other related enhancers can be used. Cellulose and cellulose derivatives can be used. Amino acids can be used, such as use in a buffer formulation.

Also, the use of liposomes, microcapsules or microspheres, inclusion complexes, or other types of carriers is contemplated.

Formulations suitable for use with a nebulizer, either jet or ultrasonic, will typically comprise the inventive compound dissolved in water at a concentration of about 0.1 to 25 mg of biologically active protein per mL of solution. The formulation can also include a buffer and a simple sugar (e.g., for protein stabilization and regulation of osmotic pressure). The nebulizer formulation can also contain a surfactant, to reduce or prevent surface induced aggregation of the protein caused by atomization of the solution in forming the aerosol.

Formulations for use with a metered-dose inhaler device will generally comprise a finely divided powder containing the inventive compound suspended in a propellant with the aid of a surfactant. The propellant can be any conventional material employed for this purpose, such as a chlorofluorocarbon, a hydrochlorofluorocarbon, a hydrofluorocarbon, or a hydrocarbon, including trichlorofluoromethane, dichlorodifluoromethane, dichlorotetrafluoroethanol, and 1,1,1,2-tetrafluoroethane, or combinations thereof. Suitable surfactants include sorbitan trioleate and soya lecithin. Oleic acid can also be useful as a surfactant. (See, e.g., Backström et al., Aerosol drug formulations containing hydrofluoroalkanes and alkyl saccharides, U.S. Pat. No. 6,932,962).

Formulations for dispensing from a powder inhaler device will comprise a finely divided dry powder containing the inventive compound and can also include a bulking agent, such as lactose, sorbitol, sucrose, mannitol, trehalose, or xylitol in amounts which facilitate dispersal of the powder from the device, e.g., 50 to 90% by weight of the formulation.

Nasal delivery forms. In accordance with the present invention, intranasal delivery of the inventive composition of matter and/or pharmaceutical compositions is also useful, which allows passage thereof to the blood stream directly after administration to the inside of the nose, without the necessity for deposition of the product in the lung. Formulations suitable for intransal administration include those with dextran or cyclodextran, and intranasal delivery devices are known. (See, e.g, Freezer, Inhaler, U.S. Pat. No. 4,083,368).

Transdermal and transmucosal (e.g., buccal) delivery forms). In some embodiments, the inventive composition is configured as a part of a pharmaceutically acceptable transdermal or transmucosal patch or a troche. Transdermal patch drug delivery systems, for example, matrix type transdermal patches, are known and useful for practicing some embodiments of the present pharmaceutical compositions. (E.g., Chien et al., Transdermal estrogen/progestin dosage unit, system and process, U.S. Pat. Nos. 4,906,169 and 5,023,084; Cleary et al., Diffusion matrix for transdermal drug administration and transdermal drug delivery devices including same, U.S. Pat. No. 4,911,916; Teillaud et al., EVA-based transdermal matrix system for the administration of an estrogen and/or a progestogen, U.S. Pat. No. 5,605,702; Venkateshwaran et al., Transdermal drug delivery matrix for coadministering estradiol and another steroid, U.S. Pat. No. 5,783,208; Ebert et al., Methods for providing testosterone and optionally estrogen replacement therapy to women, U.S. Pat. No. 5,460,820). A variety of pharmaceutically acceptable systems for transmucosal delivery of therapeutic agents are also known in the art and are compatible with the practice of the present invention. (E.g., Heiber et al., Transmucosal delivery of macromolecular drugs, U.S. Pat. Nos. 5,346,701 and 5,516,523; Longenecker et al., Transmembrane formulations for drug administration, U.S. Pat. No. 4,994,439).

Buccal delivery of the inventive compositions is also useful. Buccal delivery formulations are known in the art for use with peptides. For example, known tablet or patch systems configured for drug delivery through the oral mucosa (e.g., sublingual mucosa), include some embodiments that comprise an inner layer containing the drug, a permeation enhancer, such as a bile salt or fusidate, and a hydrophilic polymer, such as hydroxypropyl cellulose, hydroxypropyl methylcellulose, hydroxyethyl cellulose, dextran, pectin, polyvinyl pyrrolidone, starch, gelatin, or any number of other polymers known to be useful for this purpose. This inner layer can have one surface adapted to contact and adhere to the moist mucosal tissue of the oral cavity and can have an opposing surface adhering to an overlying non-adhesive inert layer. Optionally, such a transmucosal delivery system can be in the form of a bilayer tablet, in which the inner layer also contains additional binding agents, flavoring agents, or fillers. Some useful systems employ a non-ionic detergent along with a permeation enhancer. Transmucosal delivery devices may be in free form, such as a cream, gel, or ointment, or may comprise a determinate form such as a tablet, patch or troche. For example, delivery of the inventive composition can be via a transmucosal delivery system comprising a laminated composite of, for example, an adhesive layer, a backing layer, a permeable membrane defining a reservoir containing the inventive composition, a peel seal disc underlying the membrane, one or more heat seals, and a removable release liner. (E.g., Ebert et al., Transdermal delivery system with adhesive overlay and peel seal disc, U.S. Pat. No. 5,662,925; Chang et al., Device for administering an active agent to the skin or mucosa, U.S. Pat. Nos. 4,849,224 and 4,983,395). These examples are merely illustrative of available transmucosal drug delivery technology and are not limiting of the present invention.

Dosages. The dosage regimen involved in a method for treating the above-described conditions will be determined by the attending physician, considering various factors which modify the action of drugs, e.g. the age, condition, body weight, sex and diet of the patient, the severity of any infection, time of administration and other clinical factors. Generally, the daily regimen should be in the range of 0.1-1000 micrograms of the inventive compound per kilogram of body weight, preferably 0.1-150 micrograms per kilogram.

WORKING EXAMPLES

The compositions described above can be prepared as described below. These examples are not to be construed in any way as limiting the scope of the present invention.

Example 1

Fc-L10-ShK[1-35] Mammalian Expression

Fc-L10-ShK[1-35], also referred to as "Fc-2xL-ShK[1-35]", an inhibitor of Kv1.3. A DNA sequence coding for the Fc region of human IgG1 fused in-frame to a linker sequence and a monomer of the Kv1.3 inhibitor peptide ShK [1-35] was constructed as described below. Methods for expressing and purifying the peptibody from mammalian cells (HEK 293 and Chinese Hamster Ovary cells) are disclosed herein.

Figure 13A:
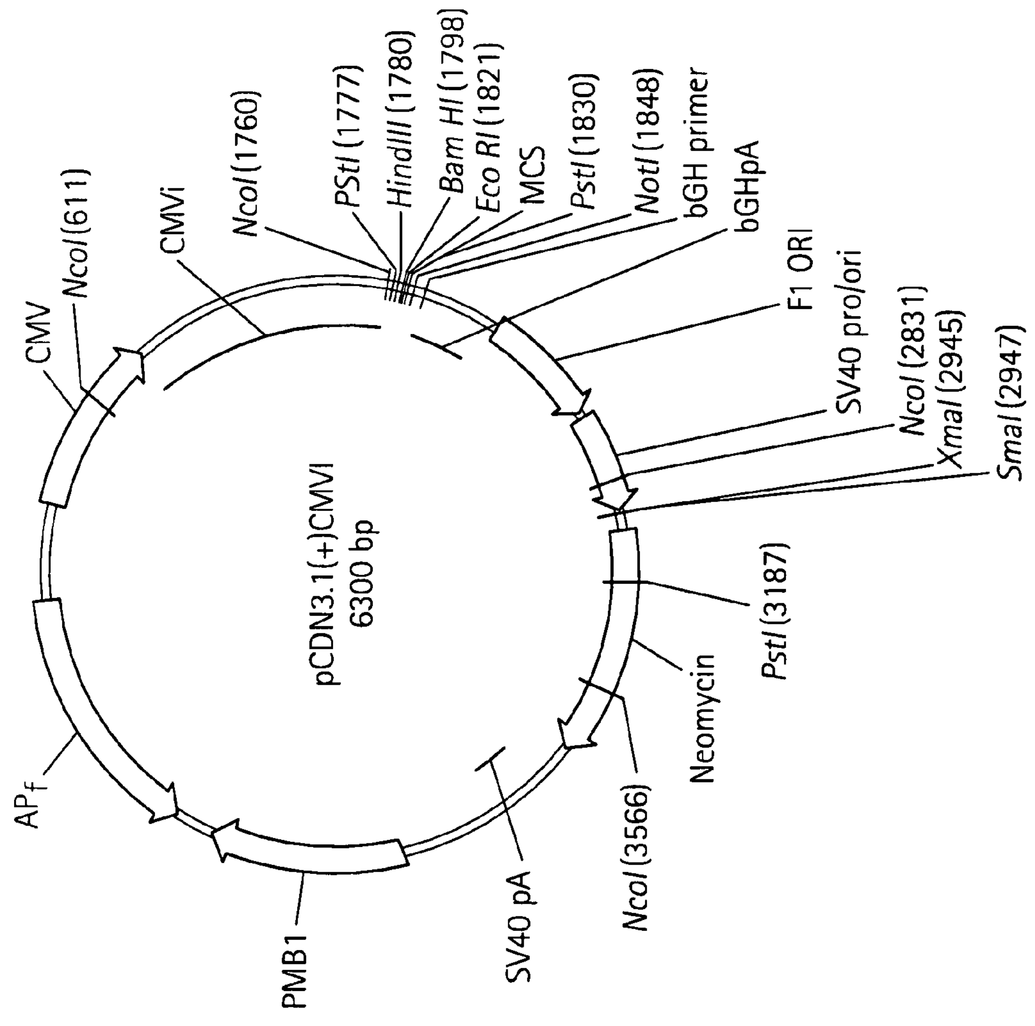
FIG. 13A is a circle diagram of mammalian expression vector pCDNA3.1(+) CMVi.
Figure 13B:
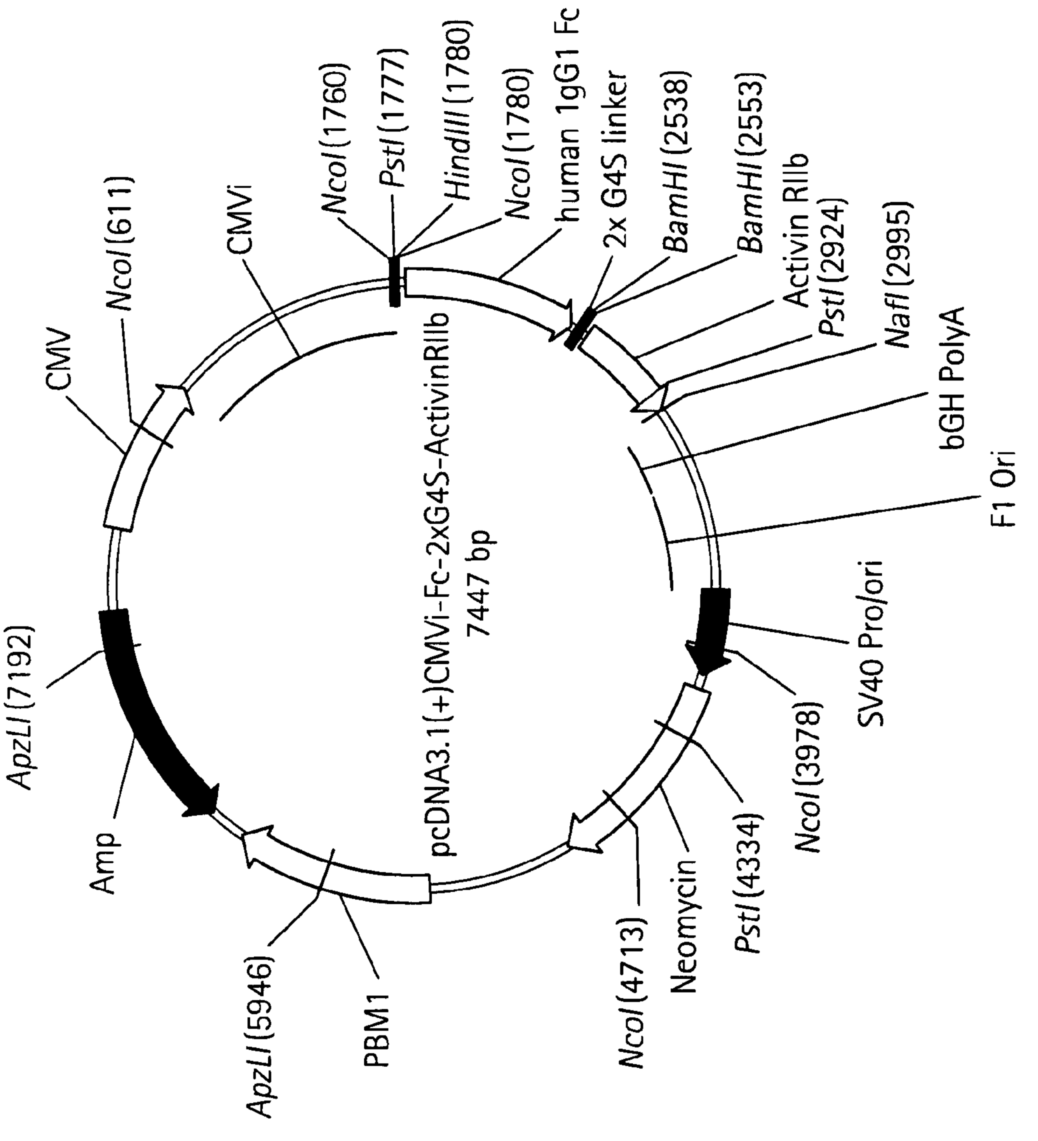
FIG. 13B is a circle diagram of mammalian expression vector pCDNA3.1 (+) CMVi-Fc-2×G4S-Activin RIIb that contains a Fc region from human IgG1, a 10 amino acid linker and the activin RIIb gene.

The expression vector pcDNA3.1(+) CMVi (FIG. 13A) was constructed by replacing the CMV promoter between MluI and HindIII in pcDNA3.1(+) with the CMV promoter plus intron (Invitrogen). The expression vector pcDNA3.1 (+) CMVi-hFc-ActivinRIIB (FIG. 13B) was generated by cloning a HindIII-NotI digested PCR product containing a 5' Kozak sequence, a signal peptide and the human Fc-linker-ActivinRIIB fusion protein with the large fragment of HindIII-NotI digested pcDNA3.1(+) CMVi. The nucleotide and amino acid sequence of the human IgG1 Fc region in pcDNA3.1(+) CMVi-hFc-ActivinRIIB is shown in FIG. 3A-3B. This vector also has a GGGGSGGGGS ("L10"; SEQ ID NO:79) linker split by a BamHI site thus enabling with the oligo below formation of the 10 amino acid linker between Fc and the ShK[1-35] peptide (see FIG. 14A-14B) for the final Fc-L10-ShK[1-35] nucleotide and amino acid sequence (FIG. 14A-14B and SEQ ID NO: 77 and SEQ ID NO:78).

The Fc-L10-ShK[1-35] expression vector was constructing using PCR stategies to generate the full length ShK gene linked to a four glycine and one serine amino acid linker (lower case letters here indicate linker sequence of L-form amino acid residues) with two stop codons and flanked by BamHI and NotI restriction sites as shown below.

```
BamHI
GGATCCGGAGGAGGAGGAAGCCGCAGC      SEQ ID NO: 657
      g   g   g   g   s   R   S
TGCATCGACACCATCCCCAAG
C   I   D   T   I   P   K
AGCCGCTGCACCGCCTTCCAG//
S   R   C   T   A   F   Q

TGCAAGCACAGCATGAAGTACCGC         SEQ ID NO: 658
C   K   H   S   M   K   Y   R
CTGAGCTTCTGCCGCAAGACC
L   S   F   C   R   K   T
TGCGGCACCTGCTAATGAGCGGCCGC
C   G   T   C         NotI//
```

Two oligos with the sequence as depicted below were used in a PCR reaction with Herculase™ polymerase (Stratagene) at 94° C.-30 sec, 50° C.-30 sec, and 72° C.-1 min for 30 cycles.

```
cat gga tcc gga gga gga gga agc   SEQ ID NO: 659
cgc agc tgc atc gac acc atc ccc
aag agc cgc tgc acc gcc ttc cag
tgc aag cac//

cat gcg gcc gct cat tag cag gtg   SEQ ID NO: 660
ccg cag gtc ttg cgg cag aag ctc
agg cgg tac ttc atg ctg tgc ttg
cac tgg aag g//
```

The resulting PCR products were resolved as the 150 bp bands on a one percent agarose gel. The 150 bp PCR product was digested with BamHI and NotI (Roche) restriction enzymes and agarose gel purified by Gel Purification Kit (Qiagen). At the same time, the pcDNA3.1 (+) CMVi-hFc-ActivinRIIB vector (FIG. 13B) was digested with BamHI and NotI restriction enzymes and the large fragment was purified by Gel Purification Kit. The gel purified PCR fragment was ligated to the purified large fragment and transformed into XL-1 blue bacteria (Stratagene). DNAs from transformed bacterial colonies were isolated and digested with BamHI and NotI restriction enzyme digestion and resolved on a one percent agarose gel. DNAs resulting in an expected pattern were submitted for sequencing. Although, analysis of several sequences of clones yielded a 100% percent match with the above sequence, only one clone was selected for large scaled plasmid purification. The DNA from Fc-2xL-ShK in pcDNA3.1(+) CMVi clone was resequenced to confirm the Fc and linker regions and the sequence was 100% identical to the predicted coding sequence, which is shown in FIG. 14A-14B.

Figure 24A:
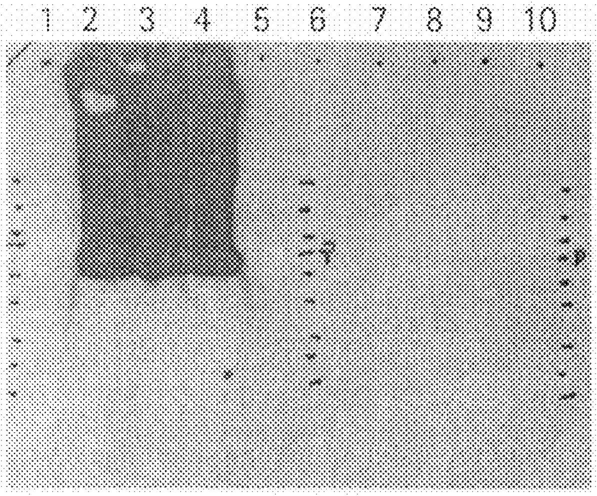
FIG. 24A shows a western blot of conditioned medium from HEK 293 cells transiently transfected with Fc-L10-ShK [1-35]. Lane 1: molecular weight markers; Lane 2: 15 μl Fc-L10-ShK; Lane 3: 10 μl Fc-L10-ShK; Lane 4: 5 μl Fc-L10-ShK; Lane 5; molecular weight markers; Lane 6: blank; Lane 7: 15 μl No DNA control; Lane 8: 10 μl No DNA control; Lane 9: 5 μl No DNA control; Lane 10; molecular weight markers.

HEK-293 cells used in transient transfection expression of Fc-2xL-ShK[1-35] in pcDNA3.1(+) CMVi protein were cultured in growth medium containing DMEM High Glucose (Gibco), 10% fetal bovine serum (FBS from Gibco) and 1× non-essential amino acid (NEAA from Gibco). 5.6 ug of Fc-2xL-ShK[1-35] in pcDNA3.1(+) CMVi plasmid that had been phenol/chloroform extracted was transfected into HEK-293 cells using Fugene 6 (Roche). The cells recovered for 24 hours, and then placed in DMEM High Glucose and 1×NEAA medium for 48 hours. The conditioned medium was concentrated 50× by running 30 ml through Centriprep YM-10 filter (Amicon) and further concentrated by a Centricon YM-10 (Amicon) filter. Various amounts of concentrated medium were mixed with an in-house 4× Loading Buffer (without B-mercaptoethanol) and electrophoresed on a Novex 4-20% tris-glycine gel using a Novex Xcell II apparatus at 101V/46 mA for 2 hours in a 5× Tank buffer solution (0.123 Tris Base, 0.96M Glycine) along with 10 ul of BenchMark Pre-Stained Protein ladder (Invitrogen). The gel was then soaked in Electroblot buffer (35 mM Tris base, 20% methanol, 192 mM glycine) for 30 minutes. A PVDF membrane from Novex (Cat. No. LC2002, 0.2 um pores size) was soaked in methanol for 30 seconds to activate the PVDF, rinsed with deionized water, and soaked in Electroblot buffer. The pre-soaked gel was blotted to the PVDF membrane using the XCell II Blot module according to the manufacturer instructions (Novex) at 40 mA for 2 hours. Then, the blot was first soaked in a 5% milk (Carnation) in Tris buffered saline solution pH7.5 (TBS) for 1 hour at room temperature and incubated with 1:500 dilution in TBS with 0.1% Tween-20 (TBST Sigma) and 1% milk buffer of the HRP-conjugated murine anti-human Fc antibody (Zymed Laboratores Cat. no. 05-3320) for two hours shaking at room temperature. The blot was then washed three times in TBST for 15 minutes per wash at room temperature. The primary antibody was detected using Amersham Pharmacia Biotech's ECL western blotting detection reagents according to manufacturer's instructions. Upon ECL detection, the western blot analysis displayed the expected size of 66 kDa under non-reducing gel conditions (FIG. 24A).

Figure 24B:
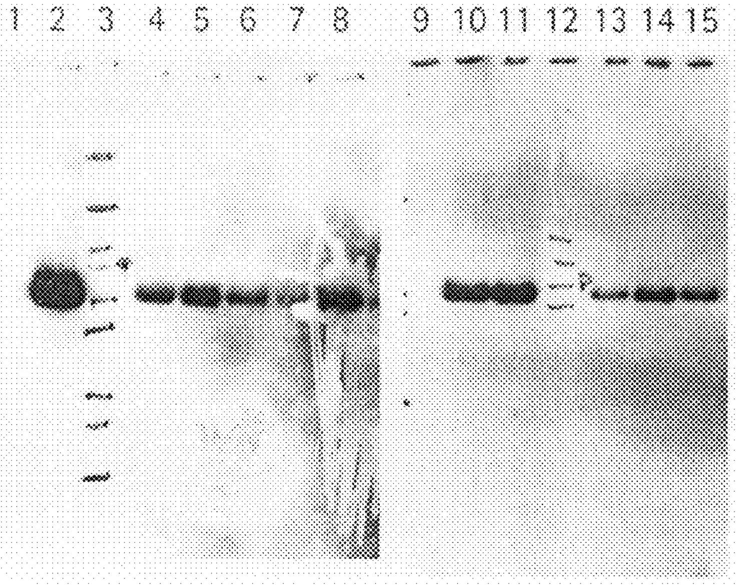
FIG. 24B shows a western blot of with 15 μl of conditioned medium from clones of Chinese Hamster Ovary (CHO) cells stably transfected with Fc-L-ShK[1-35]. Lanes 1-15 were loaded as follows: blank, BB6, molecular weight markers, BB5, BB4, BB3, BB2, BB1, blank, BD6, BD5, molecular weight markers, BD4, BD3, BD2.

AM1 CHOd- (Amgen Proprietary) cells used in the stable expression of Fc-L10-ShK[1-35] protein were cultured in AM1 CHOd-growth medium containing DMEM High Glucose, 10% fetal bovine serum, 1× hypoxantine/thymidine (HT from Gibco) and 1×NEAA. 6.5 ug of pcDNA3.1(+) CMVi-Fc-ShK plasmid was also transfected into AM1 CHOd-cells using Fugene 6. The following day, the transfected cells were plated into twenty 15 cm dishes and selected using DMEM high glucose, 10% FBS, 1×HT, 1×NEAA and Geneticin (800 μg/ml G418 from Gibco) for thirteen days. Forty-eight surviving colonies were picked into two 24-well plates. The plates were allowed to grow up for a week and then replicated for freezing. One set of each plate was transferred to AM1 CHOd-growth medium without 10% FBS for 48 hours and the conditioned media were harvested. Western Blot analysis similar to the transient Western blot analysis with detection by the same anti-human Fc antibody was used to screen 15 ul of conditioned medium for expressing stable CHO clones. Of the 48 stable clones, more than 50% gave ShK expression at the expected size of 66 kDa. The BB6, BD5 and BD6 clones were selected with BD5 and BD6 as a backup to the primary clone BB6 (FIG. 24B).

The BB6 clone was scaled up into ten roller bottles (Corning) using AM1 CHOd-growth medium and grown to confluency as judged under the microscope. Then, the medium was exchanged with a serum-free medium containing to 50% DMEM high glucose and 50% Ham's F12 (Gibco) with 1×HT and 1×NEAA and let incubate for one week. The conditioned medium was harvested at the one-week incubation time, filtered through 0.45 μm filter (Corning) and frozen. Fresh serum-free medium was added and incubated for an additional week. The conditioned serum-free medium was harvested like the first time and frozen.

Purification of monovalent and bivalent dimeric Fc-L10-ShK(1-35). Approximately 4 L of conditioned medium was thawed in a water bath at room temperature. The medium was concentrated to about 450 ml using a Satorius Sartocon Polysulfon 10 tangential flow ultra-filtration cassette (0.1 $m^2$) at room temperature. The retentate was then filtered through a 0.22 μm cellulose acetate filter with a pre-filter. The retentate was then loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9 ml) was diluted to 50 ml with water and loaded on to a 5 ml Amersham HiTrap SP-HP column in S-Buffer A (20 mM $NaH_2PO_4$, pH 7.0) at 5 ml/min and 7° C. The column was then washed with several column volumes S-Buffer A, and then developed using a linear gradient from 25% to 75% S-Buffer B (20 mM $NaH_2PO_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 3.4 ml using a Pall Life Sciences Macrosep 10K Omega centrifugal ultra-filtration device and then filtered though a Costar 0.22 μm cellulose acetate syringe filter.

Figure 26A:
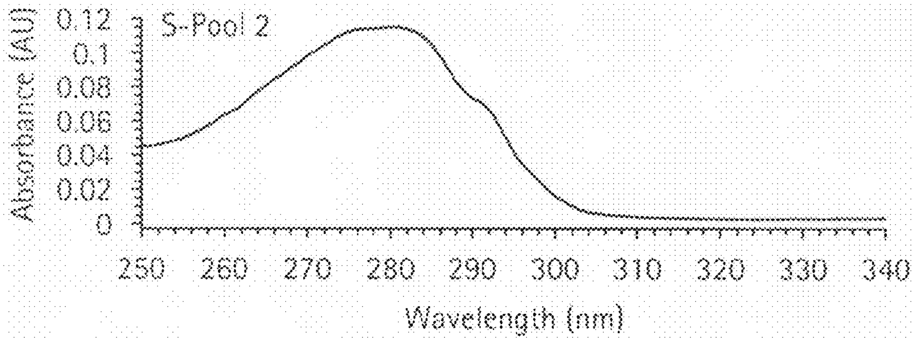
FIG. 26A shows a Spectral scan of 10 μl purified bivalent dimeric Fc-L10-ShK[1-35] product from stably transfected CHO cells diluted in 700 μl PBS (blanking buffer) using a Hewlett Packard 8453 spectrophotometer and a 1-cm path length quartz cuvette.

A spectral scan was then conducted on 10 μl of the filtered material diluted in 700 μl PBS using a Hewlett Packard 8453 spectrophotometer (FIG. 26A). The concentration of the filtered material was determined to be 5.4 mg/ml using a calculated molecular mass of 32,420 g/mol and extinction coefficient of 47,900 $M^{-1}$ $cm^{-1}$.

Figure 26B:
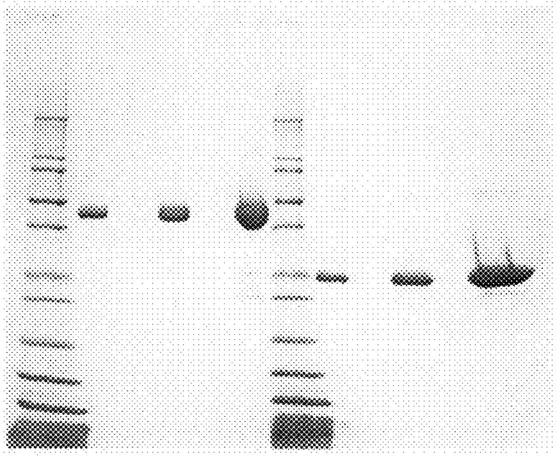
FIG. 26B shows Coomassie brilliant blue stained tris-glycine 4-20% SDS-PAGE of the final bivalent dimeric Fc-L10-ShK[1-35] product. Lanes 1-12 were loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 26C:
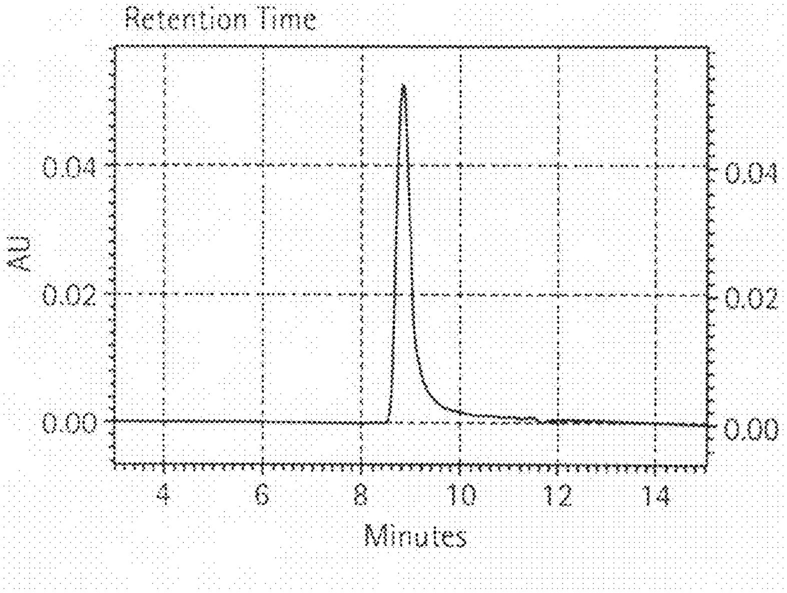
FIG. 26C shows size exclusion chromatography on 20 μg of the final bivalent dimeric Fc-L10-ShK[1-35] product injected on to a Phenomenex BioSep SEC 3000 column (7.8×300 mm) in 50 mM $NaH_2PO_4$, 250 mM NaCl, and pH 6.9 at 1 ml/min observing the absorbance at 280 nm.
Figure 26D:
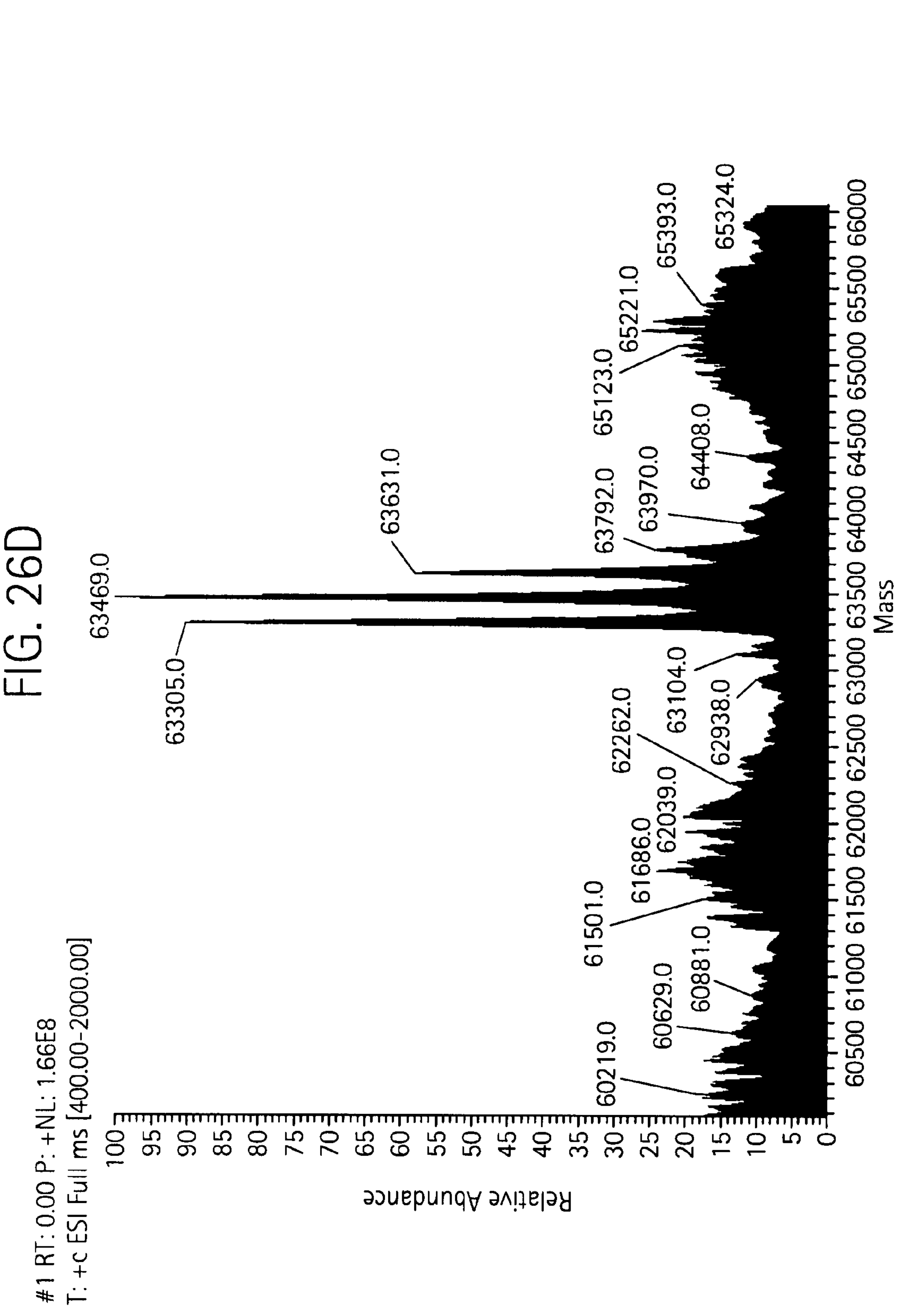
FIG. 26D shows a MALDI mass spectral analysis of the final sample of bivalent dimeric Fc-L10-ShK[1-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.
Figure 26E:
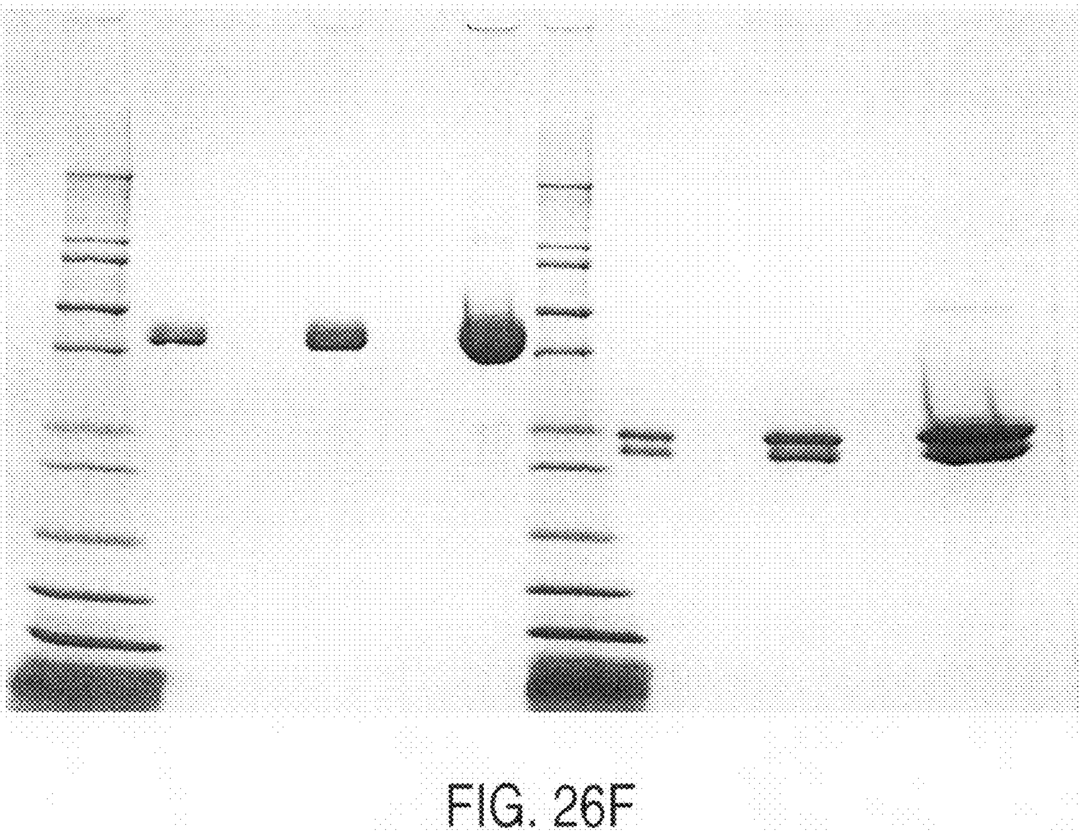
FIG. 26E shows Coomassie brilliant blue stained tris-glycine 4-20% SDS-PAGE of the final monovalent dimeric Fc-L10-ShK[1-35] product. Lanes 1-12 were loaded as follows: Novex Mark12 wide range protein standards (10 μL), 0.5 μg product non-reduced (1.3 μL), blank, 2.0 μg product non-reduced (5 μL), blank, 10 μg product non-reduced (25 μL), Novex Mark12 wide range protein standards (10 μL), 0.5 μg product reduced (1.3 μL), blank, 2.0 μg product reduced (5 μL), blank, and 10 μg product reduced (25 μL).
Figure 26F:
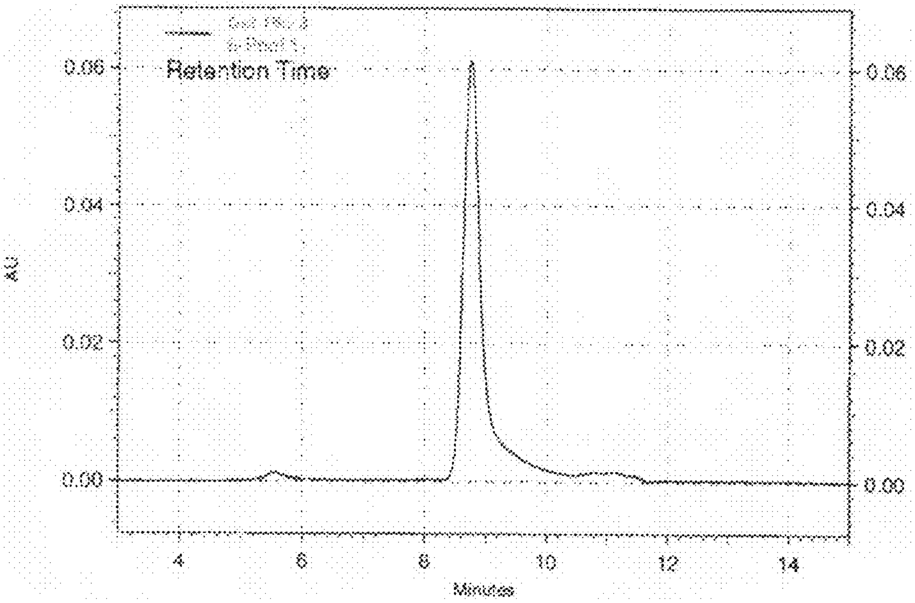
FIG. 26F shows size exclusion chromatography on 20 μg of the final monovalent dimeric Fc-L10-ShK[1-35] product injected on to a Phenomenex BioSep SEC 3000 column (7.8×300 mm) in 50 mM $NaH_2PO_4$, 250 mM NaCl, and pH 6.9 at 1 ml/min observing the absorbance at 280 nm.

The purity of the filtered bivalent dimeric Fc-L10-ShK(1-35) product was assessed using a Coomassie brilliant blue stained tris-glycine 4-20% SDS-PAGE (FIG. 26B). The monvalent dimeric Fc-L10-ShK(1-35) product was analyzed using reducing and non-reducing sample buffers by SDS-PAGE on a 1.0 mm TRIS-glycine 4-20% gel developed at 220 V and stained with Boston Biologicals QuickBlue (FIG. 26E). The endotoxin levels were then determined using a Charles River Laboratories Endosafe-PTS system (0.05-5 EU/ml sensitivity) using a 108-fold dilution of the sample in PBS yielding a result of <1 EU/mg protein. The macromolecular state of the products was then determined using size exclusion chromatography on 20 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 26C, bivalent dimeric Fc-L10-ShK(1-35); FIG. 26F, monovalent dimeric Fc-L10-SHK(1-35)). The product was then subject to mass spectral analysis by diluting 1 μl of the sample into 10 μl of sinapinic acid (10 mg per ml in 0.05% trifluoroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 26D) and confirmed (within experimental error) the integrity of the purified peptibody. The product was then stored at −80° C.

Purified bivalent dimeric Fc-L10-ShK[1-35] potently blocked human Kv1.3 (FIG. 30A and FIG. 30B) as determined by electrophysiology (see Example 36). The purified bivalent dimeric Fc-L10-ShK[1-35] molecule also blocked T cell proliferation (FIG. 36A and FIG. 36B) and production of the cytokines IL-2 (FIG. 35A and FIG. 37A) and IFN-g (FIG. 35B and FIG. 37B).

Example 2

Fc-L-ShK[2-35] Mammalian Expression

A DNA sequence coding for the Fc region of human IgG1 fused in-frame to a monomer of the Kv1.3 inhibitor peptide ShK[2-35] was constructed using standard PCR technology. The ShK[2-35] and the 5, 10, or 25 amino acid linker portion of the molecule were generated in a PCR reaction using the original Fc-2xL-ShK[1-35] in pcDNA3.1(+) CMVi as a template (Example 1, FIGS. 14A-14B). All ShK constructs should have the following amino acid sequence of

```
SCIDTIPKSRCTAFQCKHSMKYRLSFCRKTCGTC (SEQ ID NO: 92)
```

with the first amino acid of the wild-type sequence deleted.

The sequences of the primers used to generate Fc-L5-ShK [2-35], also referred to as "Fc-1xL-ShK[2-35]", are shown below:

```
                                        SEQ ID NO: 661
cat gga tcc agc tgc atc gac acc atc//;

                                        SEQ ID NO: 662
cat gcg gcc gct cat tag c//;
```

The sequences of the primers used to generate Fc-L10-ShK [2-35], also referred to as "Fc-2xL-ShK[2-35]" are shown below:

```
                                        SEQ ID NO: 663
cat gga tcc gga gga gga gga agc agc tgc a //;

                                        SEQ ID NO: 664
cat gcg gcc gct cat tag cag gtg c //;
```

The sequences of the primers used to generate Fc-L25-ShK [2-35], also referred to as "Fc-5xL-ShK[2-35]", are shown below:

```
                                        SEQ ID NO: 665
cat gga tcc ggg ggt ggg ggt tct ggg ggt ggg ggt
tct gga gga gga gga agc gga gga gga gga agc agc
tgc a//;

                                        SEQ ID NO: 666
cat gcg gcc gct cat tag cag gtg c//;
```

The PCR products were digested with BamHI and NotI (Roche) restriction enzymes and agarose gel purified by Gel Purification Kit. At the same time, the pcDNA3.1(+) CMVi-hFc-ActivinRIIB vector was digested with BamHI and NotI restriction enzymes and the large fragment was purified by Gel Purification Kit. Each purified PCR product was ligated to the large fragment and transformed into XL-1 blue bacteria. DNAs from transformed bacterial colonies were isolated and subjected to BamHI and NotI restriction enzyme digestions and resolved on a one percent agarose gel. DNAs resulting in an expected pattern were submitted for sequencing. Although, analysis of several sequences of clones yielded a 100% percent match with the above sequence, only one clone was selected for large scaled plasmid purification. The DNA from this clone was resequenced to confirm the Fc and linker regions and the sequence was 100% identical to the expected sequence.

Figure 13C:
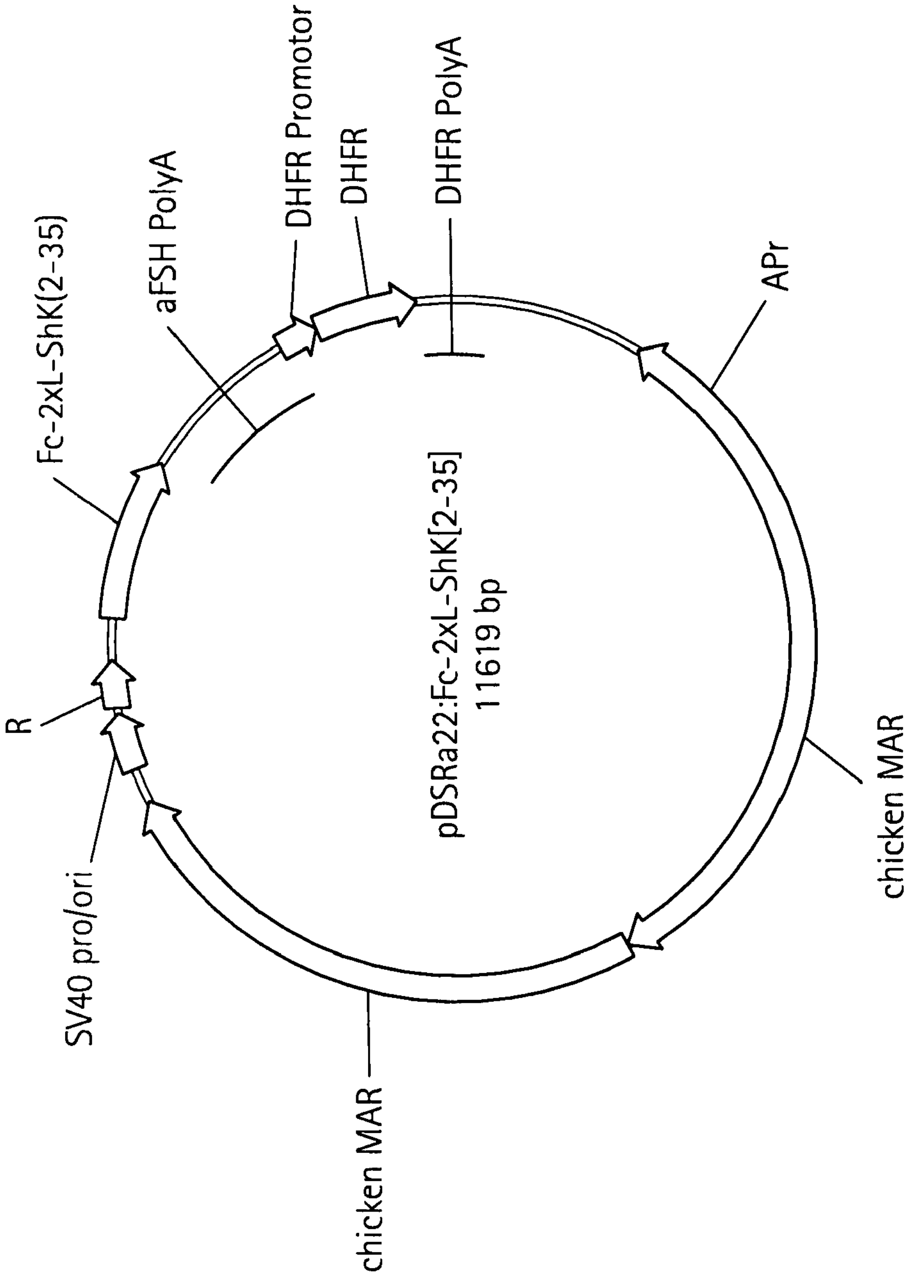
FIG. 13C is a circle diagram of the CHO expression vector pDSRa22 containing the Fc-L10-ShK[2-35] coding sequence.

Plasmids containing the Fc-1xL-Shk[2-35], Fc-2xL-Shk [2-35] and Fc-5xL-Shk[2-35] inserts in pcDNA3.1 (+) CMVi vector were digested with Xba1 and Xho1 (Roche) restriction enzymes and gel purified. The inserts were individually ligated into Not1 and SalI (Roche) digested pDSRα-22 (Amgen Proprietary) expression vector. Integrity of the resulting constructs were confirmed by DNA sequencing. The final plasmid DNA expression vector constructs were pDSRα-22-Fc-1xL-Shk[2-35], pDSRα-22-Fc-2xL-Shk[2-35] (FIG. 13C and FIG. 15A-15B) and pDSRα-22-Fc-5xL-Shk[2-35] (FIG. 16A-16B) and contained 5, 10 and 25 amino acid linkers, respectively.

Twenty-four hours prior to transfection, 1.2e7 AM-1/D CHOd- (Amgen Proprietary) cells were plated into a T-175 cm sterile tissue culture flask, to allow 70-80% confluency on the day of transfection. The cells had been maintained in the AM-1/D CHOd-culture medium containing DMEM High Glucose, 5% FBS, 1× Glutamine Pen/Strep (Gibco), 1×HT, 1×NEAA's and 1× sodium pyruvate (Gibco). The following day, eighteen micrograms of each of the linearized pDSRα22:Fc-1xL-ShK[2-35], pDSRα22:Fc-2xL-ShK[2-35] and pDSRα22:Fc-5xL-ShK[2-35] (RDS's #20050037685, 20050053709, 20050073295) plasmids were mixed with 72 μg of linearized Selexis MAR plasmid and pPAGO1 (RDS 20042009896) and diluted into 6 ml of Opti-MEM in a 50 ml conical tube and incubate for five minutes. LF2000 (210 μl) was added to 6 ml of OptiMEM and incubated for five minutes. The diluted DNA and LF2000 were mixed together and incubated for 20 minutes at room temperature. In the meantime, the cells were washed one time with PBS and then 30 ml OptiMEM without antibiotics were added to the cells. The OptiMEM was aspirated off, and the cells were incubated with 12 ml of DNA/LF2000 mixture for 6 hours or overnight in the 37° C. incubator with shaking. Twenty-four hours post transfection, the cells were split 1:5 into AM-1/D CHOd-culture medium and at differing dilutions for colony selection. Seventy-two hours post transfection, the cell medium was replaced with DHFR selection medium containing 10% Dialyzed FBS (Gibco) in DMEM High Glucose, plus 1× Glutamine Pen/Strep, 1×NEAA's and 1× Na Pyr to allow expression and secretion of protein into the cell medium. The selection medium was changed two times a week until the colonies are big enough to pick. The pDSRa22 expression vector contains a DHFR expression cassette, which allows transfected cells to grow in the absence of hypoxanthine and thymidine. The five T-175 pools of the resulting colonies were scaled up into roller bottles and cultured under serum free conditions. The conditioned media were harvested and replaced at one-week intervals. The resulting 3 liters of conditioned medium was filtered through a 0.45 μm cellulose acetate filter (Corning, Acton, Mass.) and transferred to Protein Chemistry for purification. As a backup, twelve colonies were selected from the 10 cm plates after 10-14 days on DHFR selection medium and expression levels evaluated by western blot using HRP conjugated anti human IgGFc as a probe. The three best clones expressing the highest level of each of the different linker length Fc-L-ShK [2-35] fusion proteins were expanded and frozen for future use.

Figure 27A:
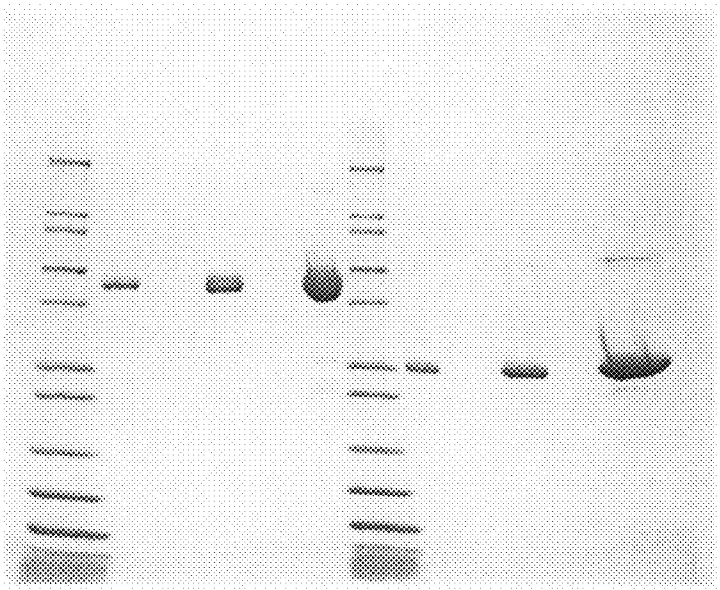
FIG. 27A shows a Coomassie brilliant blue stained tris-glycine 4-20% SDS-PAGE of the final purified bivalent dimeric Fc-L10-ShK[2-35] product from stably transfected CHO cells. Lane 1-12 were loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 27B:
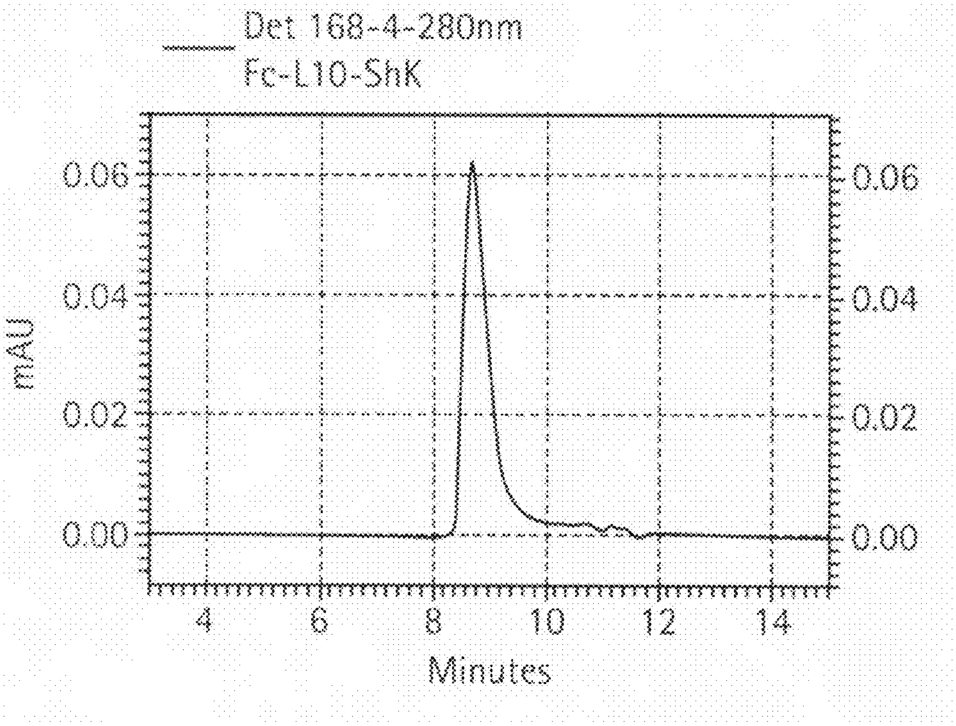
FIG. 27B shows size exclusion chromatography on 50 μg of the purified bivalent dimeric Fc-L10-ShK[2-35] injected on to a Phenomenex BioSep SEC 3000 column (7.8×300 mm) in 50 mM $NaH_2PO_4$, 250 mM NaCl, and pH 6.9 at 1 ml/min observing the absorbance at 280 nm.
Figure 27C:
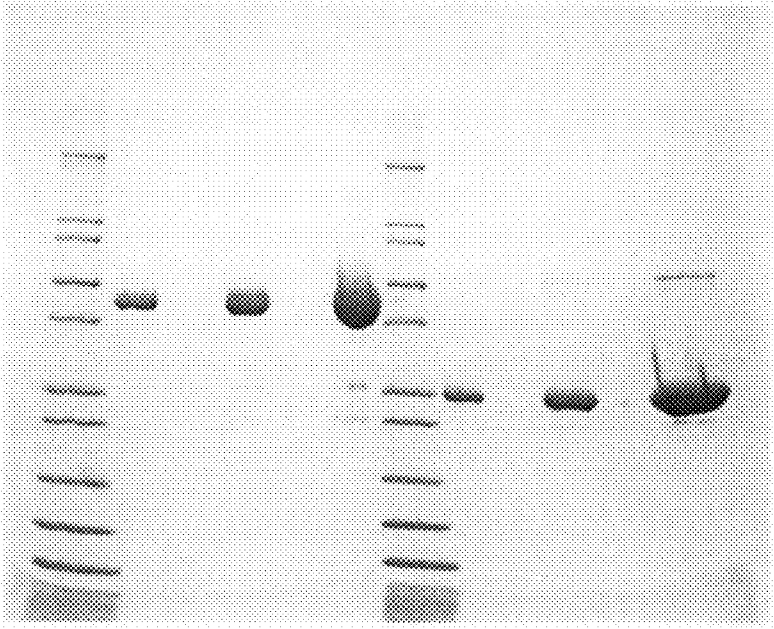
FIG. 27C shows a Coomassie brilliant blue stained tris-glycine 4-20% SDS-PAGE of bivalent dimeric Fc-L5-ShK[2-35] purified from stably transfected CHO cells. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 27D:
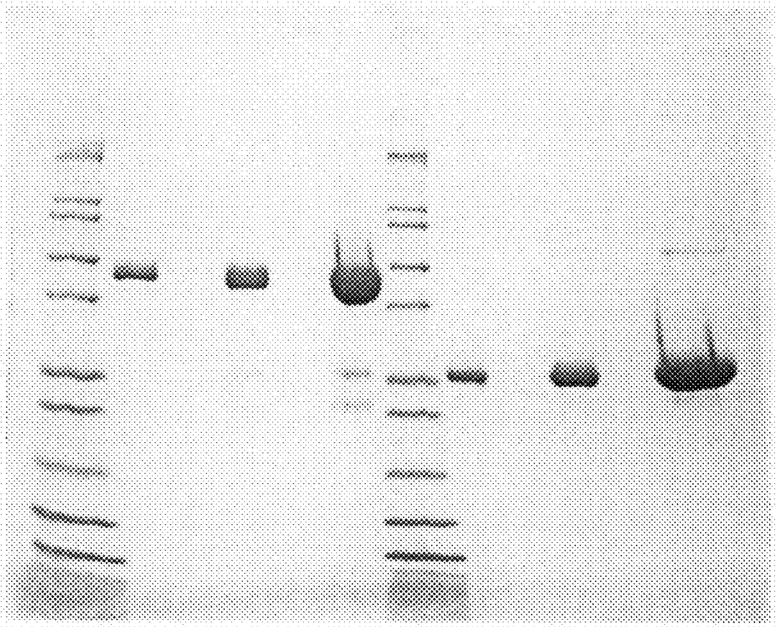
FIG. 27D shows a Coomassie brilliant blue stained tris-glycine 4-20% SDS-PAGE of bivalent dimeric Fc-L25-ShK [2-35] purified from stably transfected CHO cells. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 27E:
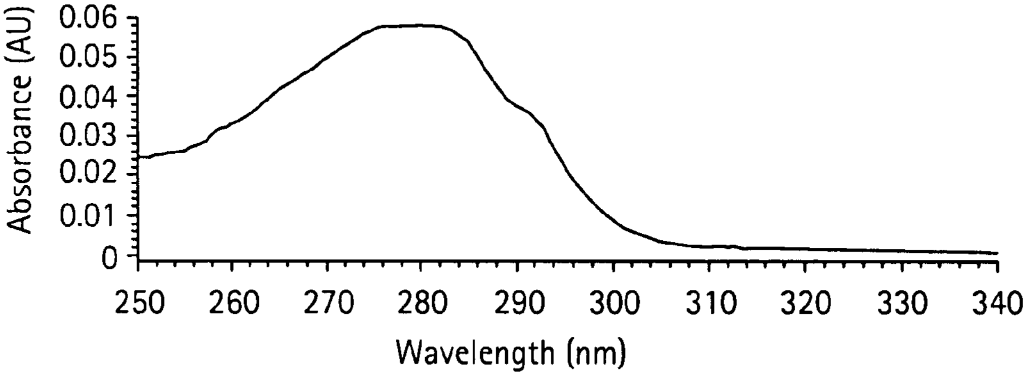
FIG. 27E shows a spectral scan of 10 μl of the bivalent dimeric Fc-L10-ShK[2-35] product diluted in 700 μl PBS (blanking buffer) using a Hewlett Packard 8453 spectrophotometer and a 1 cm path length quartz cuvette.

Purification of Fc-L10-ShK(2-35). Approximately 1 L of conditioned medium was thawed in a water bath at room temperature. The medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 8.5 ml) combined with 71 μl 3 M sodium acetate and then diluted to 50 ml with water. The diluted material was then loaded on to a 5 ml Amersham HiTrap SP-HP column in S-Buffer A (20 mM $NaH_2PO_4$, pH 7.0) at 5 ml/min 7° C. The column was then washed with several column volumes S-Buffer A, and then developed using a linear gradient from 0% to 75% S-Buffer B (20 mM $NaH_2PO_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then filtered through a 0.22 μm cellulose acetate filter and concentrated to about 3.9 ml using a Pall Life Sciences Macrosep 10K Omega centrifugal ultra-filtration device. The concentrated material was then filtered though a Pall Life Sciences Acrodisc with a 0.22 μm, 25 mm Mustang E membrane at 2 ml/min room temperature. A spectral scan was then conducted on 10 μl of the filtered material diluted in 700 μl PBS using a Hewlett Packard 8453 spectrophotometer (FIG. 27E). The concentration of the filtered material was determined to be 2.76 mg/ml using a calculated molecular mass of 30,008 g/mol and extinction coefficient of 36,900 $M^{-1}$ $cm^{-1}$. Since material was found in the permeate, repeated concentration step on the permeate using a new Macrosep cartridge. The new batch of concentrated material was then filtered though a Pall Life Sciences Acrodisc with a 0.22 μm, 25 mm Mustang E membrane at 2 ml/min room temperature. Both lots of concentrated material were combined into one pool.

Figure 27F:
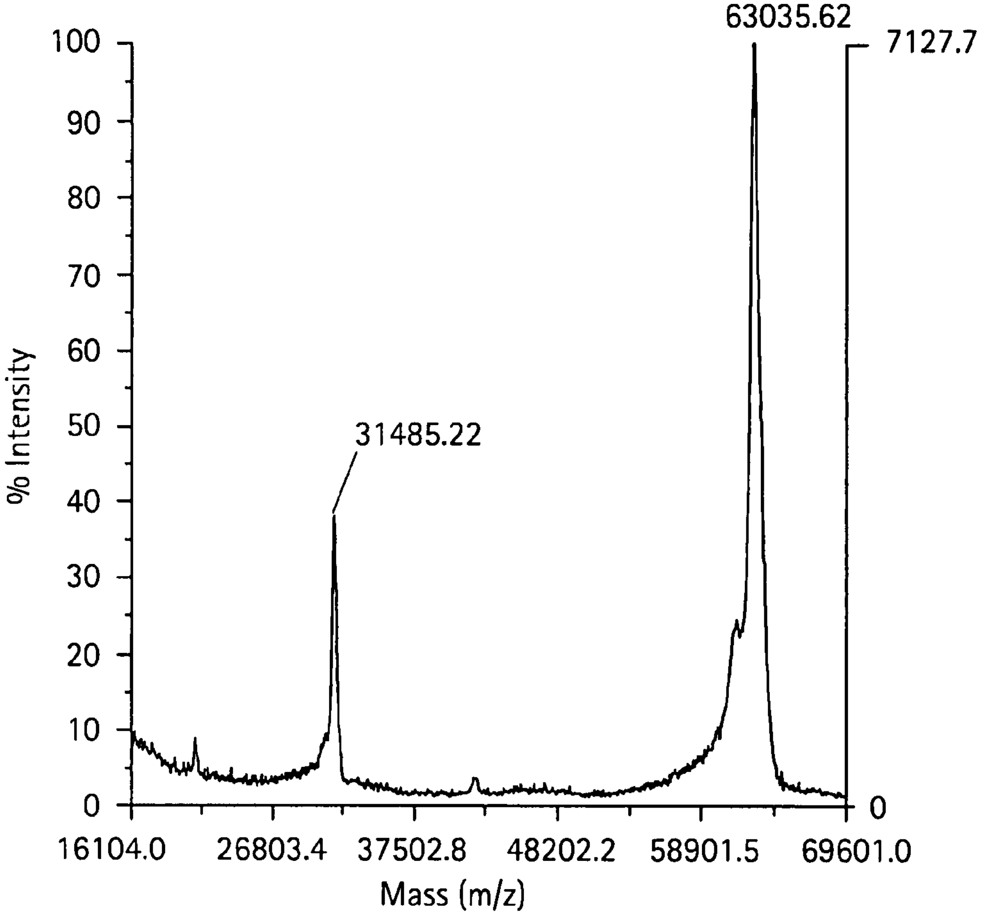
FIG. 27F shows a MALDI mass spectral analysis of the final sample of bivalent dimeric Fc-L110-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.

A spectral scan was then conducted on 10 μl of the combined pool diluted in 700 μl PBS using a Hewlett Packard 8453 spectrophotometer. The concentration of the filtered material was determined to be 3.33 mg/ml using a calculated molecular mass of 30,008 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 27A). The endotoxin level was then determined using a Charles River Laboratories Endosafe-PTS system (0.05-5 EU/ml sensitivity) using a 67-fold dilution of the sample in PBS yielding a result of <1 EU/mg protein. The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 27B). The product was then subject to mass spectral analysis by diluting 1 μl of the sample into 10 μl of sinapinic acid (10 mg per ml in 0.05% trifluoroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 27F) and the experiment confirmed the integrity of the peptibody, within experimental error. The product was then stored at −80° C.

FIG. 31B shows that purified Fc-L10-ShK[2-35] potently blocks human Kv1.3 current (electrophysiology was done as described in Example 36). The purified Fc-L10-ShK[2-35] molecule also blocked IL-2 (FIG. 64A and FIG. 64B) and IFN-g (FIG. 65A and FIG. 65B) production in human whole blood, as well as, upregulation of CD40L (FIG. 66A and FIG. 66B) and IL-2R (FIG. 67A and FIG. 67B) on T cells.

Purification of Fc-L5-ShK(2-35). Approximately 1 L of conditioned medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9 ml) combined with 450 μl 1 M tris HCl pH 8.5 followed by 230 μl 2 M acetic acid then diluted to 50 ml with water. The pH adjusted material was then filtered through a 0.22 μm cellulose acetate filter and loaded on to a 5 ml Amersham HiTrap SP-HP column in S-Buffer A (20 mM $NaH_2PO_4$, pH 7.0) at 5 ml/min 7° C. The column was then washed with several column volumes S-Buffer A, and then developed using a linear gradient from 0% to 75% S-Buffer B (20 mM $NaH_2PO_4$, 1 M NaCl, pH 7.0) at 5 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 5.5 ml using a Pall Life Sciences Macrosep 10K Omega centrifugal ultra-filtration device. The concentrated material was then filtered though a Pall Life Sciences Acrodisc with a 0.22 μm, 25 mm Mustang E membrane at 2 ml/min room temperature.

Figure 27G:
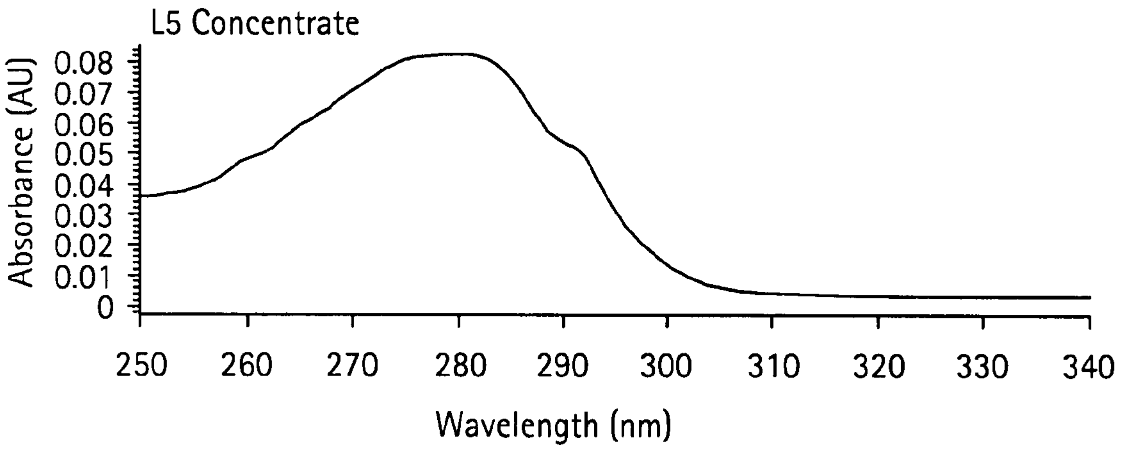
FIG. 27G shows a spectral scan of 10 μl of the bivalent dimeric Fc-L5-ShK[2-35] product diluted in 700 μl PBS (blanking buffer) using a Hewlett Packard 8453 spectrophotometer and a 1 cm path length quartz cuvette.
Figure 27H:
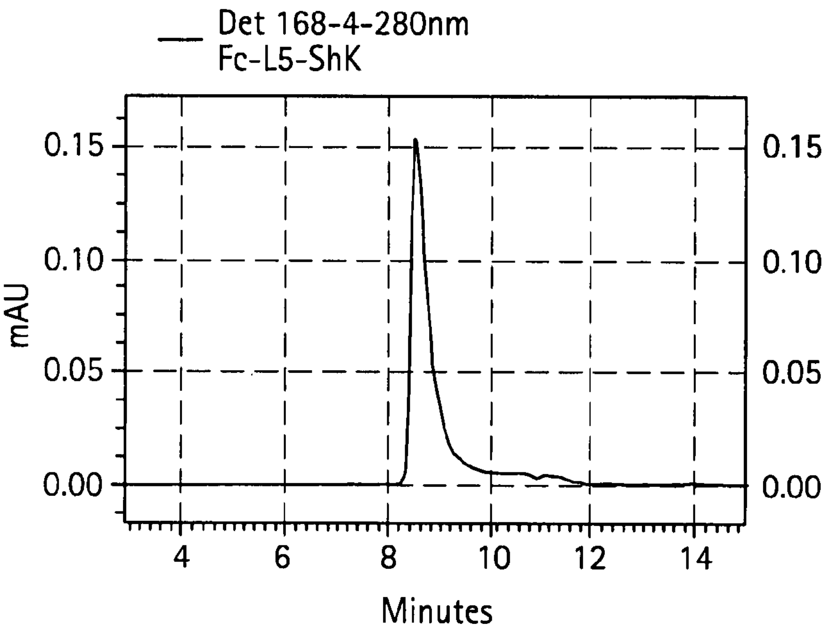
FIG. 27H shows the size exclusion chromatography on 50 mg of the final bivalent dimeric Fc-L5-ShK[2-35] product injected on to a Phenomenex BioSep SEC 3000 column (7.8×300 mm) in 50 mM NaH2PO4, 250 mM NaCl, pH 6.9 at 1 ml/min observing the absorbance at 280 nm.
Figure 27I:
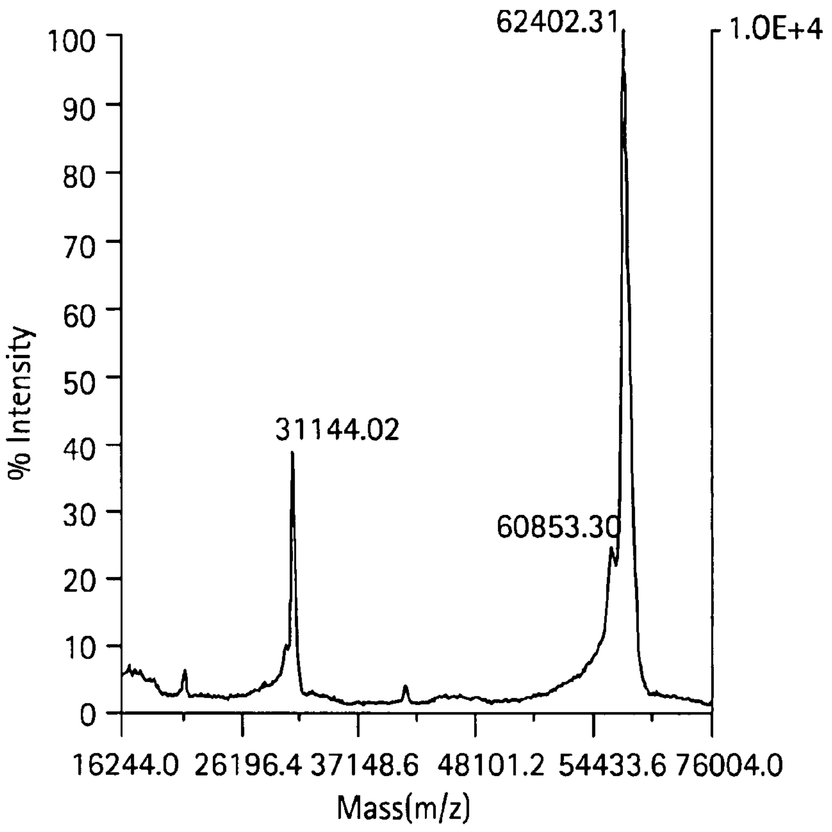
FIG. 27I shows a MALDI mass spectral analysis of the final sample of bivalent dimeric Fc-L5-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

A spectral scan was then conducted on 10 μl of the combined pool diluted in 700111 PBS using a Hewlett Packard 8453 spectrophotometer (FIG. 27G). The concentration of the filtered material was determined to be 4.59 mg/ml using a calculated molecular mass of 29,750 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 27C). The endotoxin level was then determined using a Charles River Laboratories Endosafe-PTS system (0.05-5 EU/ml sensitivity) using a 92-fold dilution of the sample in Charles Rivers Endotoxin Specific Buffer BG120 yielding a result of <1 EU/mg protein. The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 27H). The product was then subject to mass spectral analysis by diluting 1 μl of the sample into 10 μl of sinapinic acid (10 mg per ml in 0.05% trifluoroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 271) and confirmed the integrity of the peptibody, within experimental error. The product was then stored at 80° C.

FIG. 31C shows that purified Fc-L5-ShK[2-35] is highly active and blocks human Kv1.3 as determined by whole cell patch clamp electrophysiology (see Example 36).

Purification of Fc-L25-ShK(2-35). Approximately 1 L of conditioned medium was loaded on to a 5 ml Amersham HiTrap Protein A column at 5 ml/min 7° C., and the column was washed with several column volumes of Dulbecco's phosphate buffered saline without divalent cations (PBS) and sample was eluted with a step to 100 mM glycine pH 3.0. The protein A elution pool (approximately 9.5 ml) combined with 119 μl 3 M sodium acetate and then diluted to 50 ml with water. The pH adjusted material was then loaded on to a 5 ml Amersham HiTrap SP-HP column in S-Buffer A (20 mM $NaH_2PO_4$, pH 7.0) at 5 ml/min 7° C. The column was then washed with several column volumes S-Buffer A, and then developed using a linear gradient from 0% to 75% S-Buffer B (20 mM $NaH_2PO_4$, 1 M NaCl, pH 7.0) at 5 ml/min followed by a step to 100% S-Buffer B at 7° C. Fractions containing the main peak from the chromatogram were pooled and filtered through a 0.22 μm cellulose acetate filter.

Figure 27J:
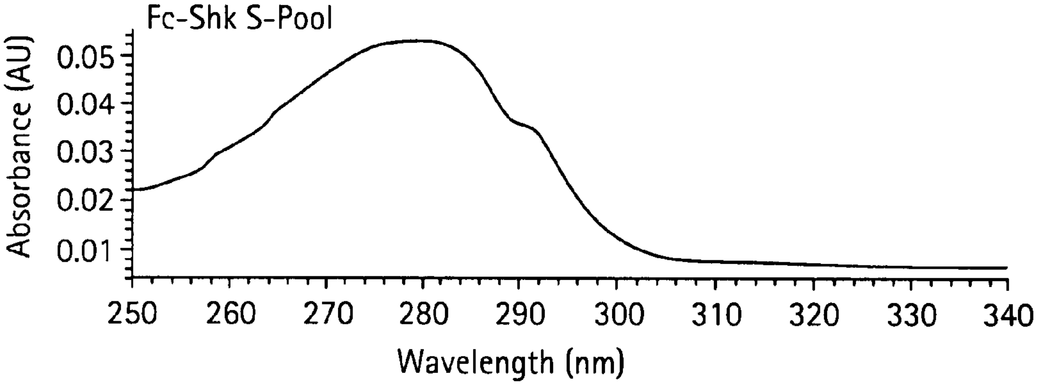
FIG. 27J shows a Spectral scan of 20 μl of the product diluted in 700 μl PBS (blanking buffer) using a Hewlett Packard 8453 spectrophotometer and a 1 cm path length quartz cuvette.
Figure 27K:
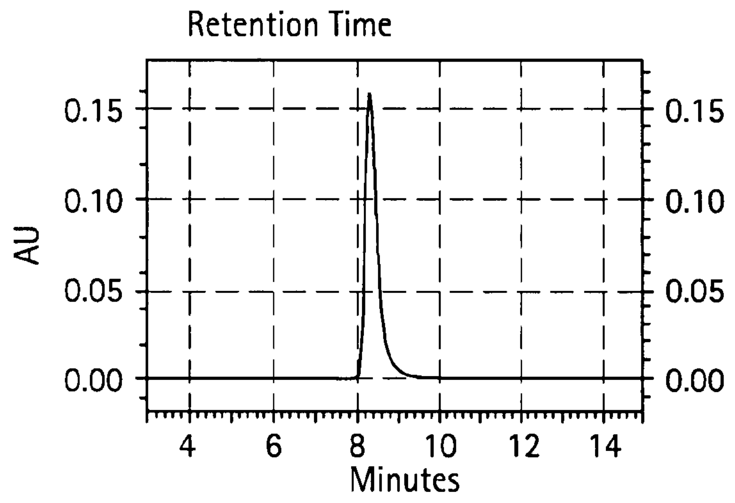
FIG. 27K shows the size exclusion chromatography on 50 μg of the final bivalent dimeric Fc-L25-ShK[2-35] product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.
Figure 27L:
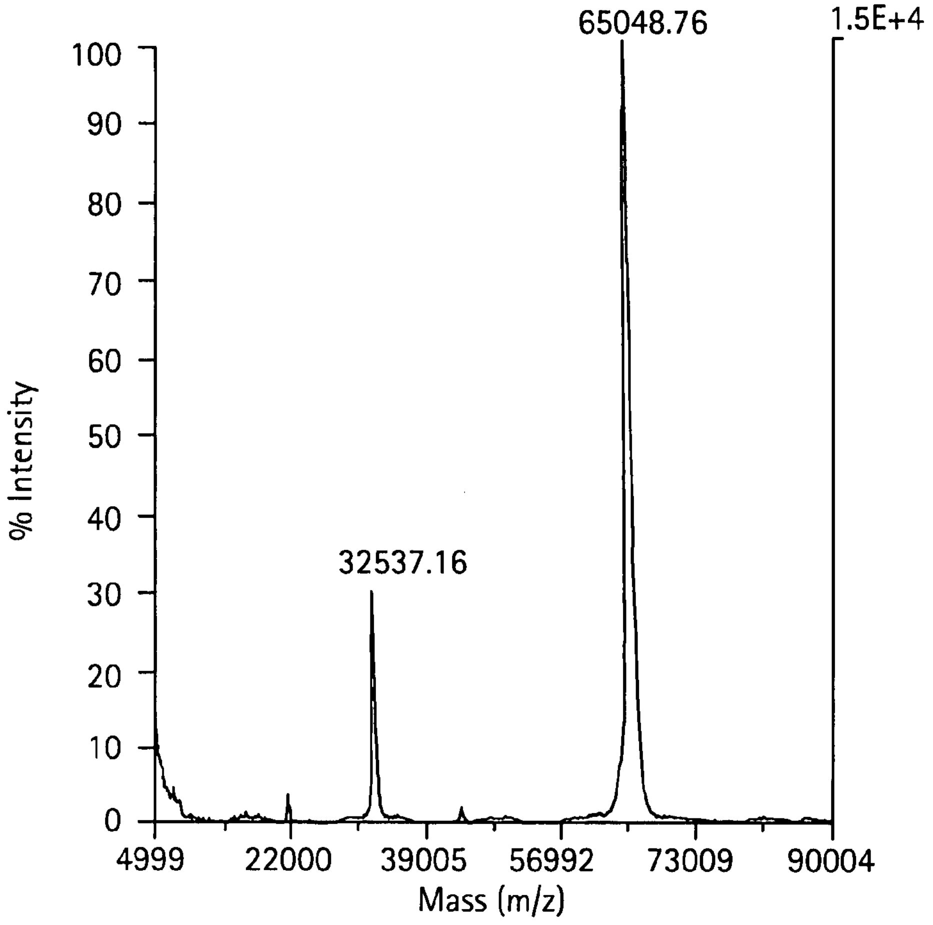
FIG. 27L shows a MALDI mass spectral analysis of the final sample of bivalent dimeric Fc-L25-ShK[2-35] analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses.

A spectral scan was then conducted on 20 μl of the combined pool diluted in 700111 PBS using a Hewlett Packard 8453 spectrophotometer FIG. 27J. The concentration of the filtered material was determined to be 1.40 mg/ml using a calculated molecular mass of 31,011 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 27D). The endotoxin level was then determined using a Charles River Laboratories Endosafe-PTS system (0.05-5 EU/ml sensitivity) using a 28-fold dilution of the sample in Charles Rivers Endotoxin Specific Buffer BG120 yielding a result of <1 EU/mg protein. The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 27K). The product was then subject to mass spectral analysis by diluting 1 μl of the sample into 10 μl of sinapinic acid (10 mg per ml in 0.05% trifluoroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 27L) and this confirmed the integrity of the peptibody, within experimental error. The product was then stored at −80° C.

Purified Fc-L25-ShK[2-35] inhibited human Kv1.3 with an $IC_{50}$ of ~150 pM by whole cell patch clamp electrophysiology on HEK293/Kv1.3 cells (Example 36).

Example 3

Fc-L-ShK[1-35] Bacterial Expression

Description of bacterial peptibody expression vectors and procedures for cloning and expression of peptibodies. The cloning vector used for bacterial expression (Examples 3-30) is based on pAMG21 (originally described in U.S. Patent 2004/0044188). It has been modified in that the kanamycin resistance component has been replaced with ampicillin resistance by excising the DNA between the unique BstBI and NsiI sites of the vector and replacing with an appropriately digested PCR fragment bearing the beta-lactamase gene using PCR primers CCA ACA CAC TTC GAA AGA CGT TGA TCG GCA C (SEQ ID NO: 667) and CAC CCA ACA ATG CAT CCT TAA AAA AAT TAC GCC C (SEQ ID NO: 668) with pUC19 DNA as the template source of the beta-lactamase gene conferring resistance to ampicillin. The new version is called pAMG21ampR.

Figure 11D:
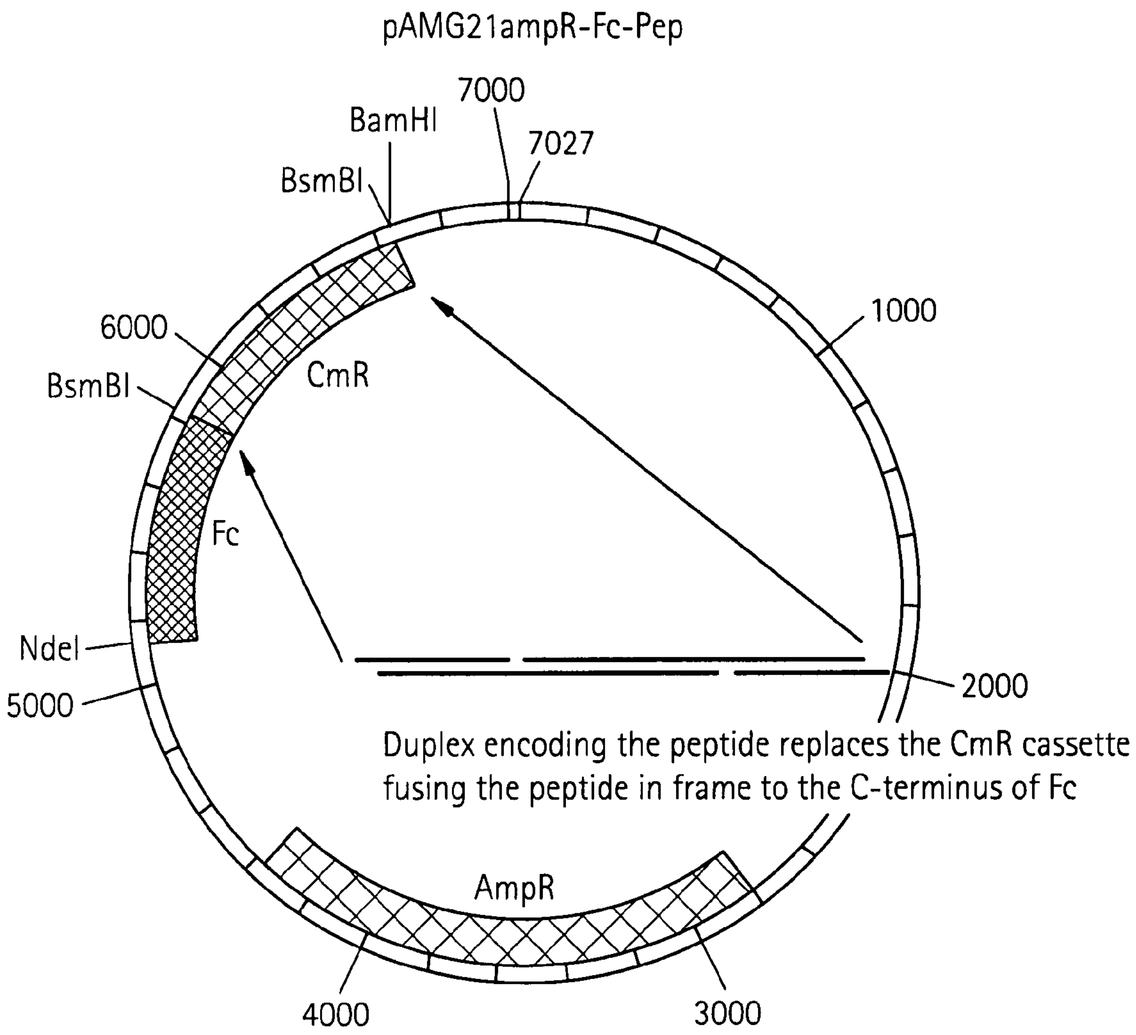
FIG. 11D shows a circle diagram of a peptibody bacterial expression vector pAMG21ampR-Fc-pep having a chloramphenicol acetyltransferase gene (cat; "CmR" site) that is replaced with the peptide-linker sequence.

Description of cloning vector pAMG21ampR-Fc-Pep used in examples 3 to 30, excluding 15 and 16. FIG. 11A-C and FIG. 11D (schematic diagram) show the ds-DNA that has been added to the basic vector pAMG21ampR to permit the cloning of peptide fusions to the C-terminus of the Fc gene. The DNA has been introduced between the unique NdeI and BamHI sites in the pAMG21ampR vector. This entire region of DNA is shown in FIG. 11A-C. The coding region for Fc extends from nt 5134 to 5817 and the protein sequence appears below the DNA sequence. This is followed in frame by a glyX5 linker (nt's 5818-5832). A BsmBI site (GAGACG) spansnucleotides 5834-5839. DNA cleavage occurs between nucleotides 5828 and 5829 on the upper DNA strand and between nucleotides 5832 and 5833 on the lower DNA strand. Digestion creates 4 bp cohesive termini as shown here. The BsmBI site is underlined.

```
AGGTGG                  TGGTTGAGACG SEQ ID NO: 683

TCCACCACCA                   ACTCTGC
SEQ ID NO: 684
```

A second BsmBI site occurs at nucleotides 6643 through 6648; viz., CGTCTC. DNA cleavage occurs between nucleotides 6650 and 6651 on the upper strand and between 6654 and 6655 on the lower strand.

CGTCTCT TAAGGATCCG SEQ ID NO: 685

GCAGAGAATTC CTAGGC
SEQ ID NO: 686

Between the two BsmBI sites is a dispensable chloramphenicol resistance cassette constitutively expressing chloramphenicol acetyltransferase (cat gene). The cat protein sequence:

```
  1 MEKKITGYTT VDISQWHRKE HFEAFQSVAQ CTYNQTVQLD ITAFLKTVKK SEQ ID NO: 1337

 51 NKHKFYPAFI HILARLMNAH PEFRMAMKDG ELVIWDSVHP CYTVFHEQTE

101 TFSSLWSEYH DDFRQFLHIY SQDVACYGEN LAYFPKGFIE NMFFVSANPW

151 VSFTSFDLNV ANMDNFFAPV FTMGKYYTQG DKVLMPLAIQ VHHAVCDGFH

201 VGRMLNELQQ YCDEWQGGA//
```

is shown in FIG. 11A-C and extends from nucleotides 5954 to 6610. The peptide encoding duplexes in each example (except Examples 15 and 16) bear cohesive ends complementary to those presented by the vector.

Figure 12D:
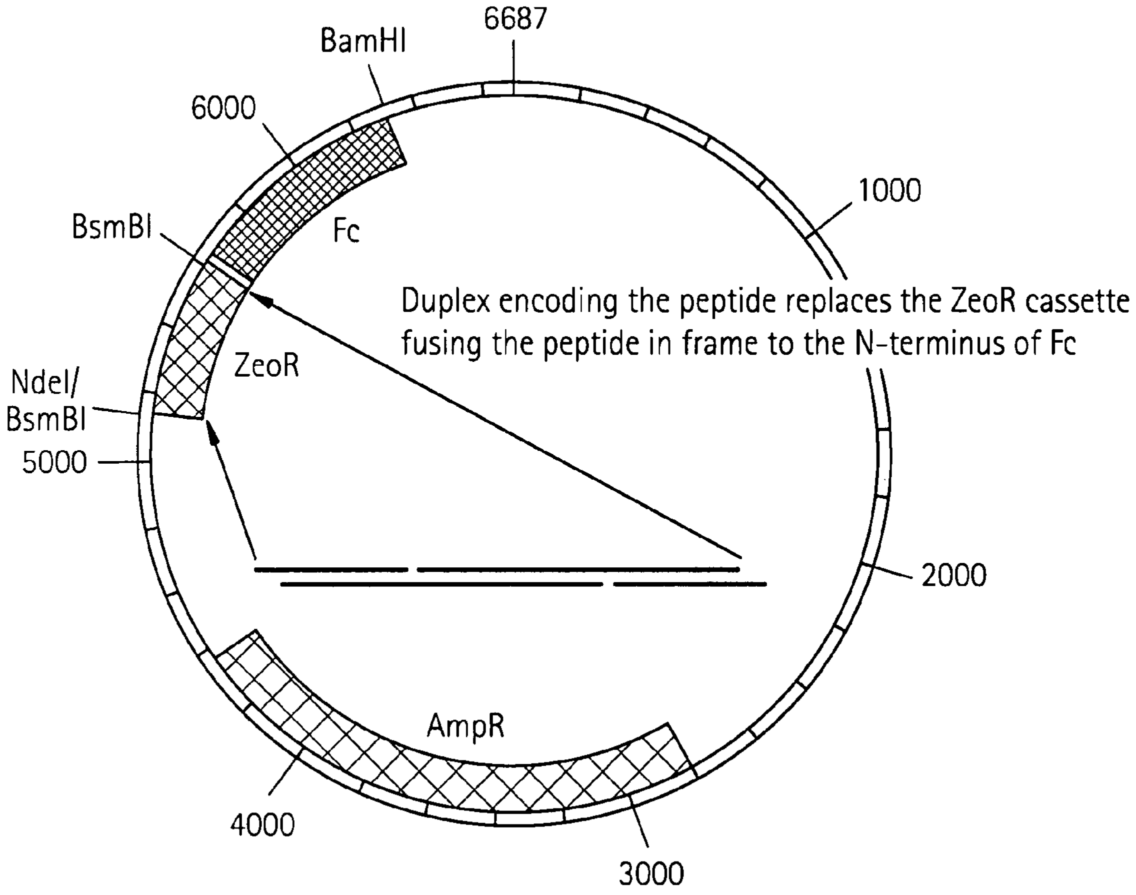
FIG. 12D shows a circle diagram of a peptibody bacterial expression vector having a zeocin resistance (ble; "ZeoR") site that is replaced with the peptide-linker sequence.

Description of the cloning vector pAMG21ampR-Pep-Fc used in examples 15 and 16. FIGS. 12A-C, and the schematic diagram in FIG. 12D, shows the ds-DNA sequence that has been added to the basic vector pAMG21ampR to permit the cloning of peptide fusions to the N-terminus of the Fc gene. The DNA has been introduced between the unique NdeI and BamHI sites in the pAMG21ampR vector. The coding region for Fc extends from nt 5640 to 6309 and the protein sequence appears below the DNA sequence. This is preceded in frame by a glyX5 linker (nt's 5614-5628). A BsmBI site spans nucleotides 5138 to 5143; viz., GAGACG. The cutting occurs between nucleotides 5132 and 5133 on the upper DNA strand and between 5136 and 5137 on the lower DNA strand.

Digestion creates 4 bp cohesive termini as shown. The BsmBI site is underlined.

AATAACA TATGCGAGACG SEQ ID NO: 687

TTATTGTATAC GCTCTGC
SEQ ID NO: 688

A second BsmBI site occurs at nucleotides 5607 through 5612; viz., CGTCTC. Cutting occurs between nucleotides 5613 and 5614 on the upper strand and between 5617 and 5618 on the lower strand.

CGTCTCA GGTGGTGGT
GCAGAGTCCAC CACCA
SEQ ID NO: 689

Between the BsmBI sites is a dispensable zeocin resistance cassette constitutively expressing the *Shigella* ble protein. The ble protein sequence:

is shown extending from nucleotides 5217 to 5588 in FIG. 12A-C. The peptide encoding duplexes in Examples 15 and 16 bear cohesive ends complementary to those presented by the vector.

Description of the cloning vector pAMG21ampR-Pep-Fc used in Examples 52 and 53. FIGS. 12E-G shows the ds-DNA sequence that has been added to the basic vector pAMG21ampR to permit the cloning of peptide fusions to the N-terminus of the Fc gene in which the first two codons of the peptide are to be met-gly. The DNA has been introduced between the unique NdeI and BamHI sites in the pAMG21ampR vector. The coding region for Fc extends from nt 5632 to 6312 and the protein sequence appears below the DNA sequence. This is preceded in frame by a glyX5 linker (nt's 5617-5631). A BsmBI site spans nucleotides 5141 to 5146; viz., GAGACG. The cutting occurs between nucleotides 5135 and 5136 on the upper DNA strand and between 5139 and 5140 on the lower DNA strand.

Digestion creates 4 bp cohesive termini as shown. The BsmBI site is underlined.

AATAACATAT GGGTCGAGACG SEQ ID NO: 1344
SEQ ID NO: 1343

TTATTGTATACCCA GCTCTGC
SEQ ID NO: 1345

A second BsmBI site occurs at nucleotides 5607 through 5612; viz., CGTCTC. Cutting occurs between nucleotides 5613 and 5614 on the upper strand and between 5617 and 5618 on the lower strand.

CGTCTCA GGTGGTGGT

GCAGAGTCCAC SEQ ID NO: 1346 CACCA

Between the BsmBI sites is a dispensable zeocin resistance cassette constitutively expressing the *Shigella* ble protein. The ble protein sequence, as described above, is shown extending from nucleotide positions 5220 to 5591. The peptide encoding duplexes in Examples 52 and 53 herein below bear cohesive ends complementary to those presented by the vector.

For Examples 3 to 30 for which all are for bacterial expression, cloned peptide sequences are all derived from the annealing of oligonucleotides to create a DNA duplex that is

```
  1 MAKLTSAVPV LTARDVAGAV EFWTDRLGFS RDFVEDDFAG VVRDDVTLFI SEQ ID NO: 1338

 51 SAVQDQVVPD NTLAWVWVRG LDELYAEWSE VVSTNFRDAS GPAMTEIGEQ

101 PWGREFALRD PAGNCVHFVA EEQD//
```

directly ligated into the appropriate vector. Two oligos suffice for Example 20, four are required for all other examples. When the duplex is to be inserted at the N-terminus of Fc (see, Examples 15, 16, 52, and 53 herein) the design is as follows with the ordinal numbers matching the listing of oligos in each example:

```
        First Oligo        Second Oligo
TATG  ________________  ______________________
      ______________________  __________________  CCAC
          Fourth Oligo          Third Oligo
```

When the duplex is to be inserted at the C-terminus of Fc (Examples 3, 4, 5, 10, 11, 12, 13, and 30) the design is as follows:

```
          First Oligo         Second Oligo
TGGT  ______________________  ________________
      __________________  ______________________  ATTC
         Fourth Oligo          Third Oligo
```

All remaining examples have the duplex inserted at the C-terminus of Fc and utilize the following design.

```
       First Oligo        Second Oligo
TGGT  ________________  ______________________
      ______________________  __________________  ATTC
         Fourth Oligo             Third Oligo
```

No kinasing step is required for the phosphorylation of any of the oligos. A successful insertion of a duplex results in the replacement of the dispensable antibiotic resistance cassette (Zeocin resistance for pAMG21ampR-Pep-Fc and chloramphenicol resistance for pAMG21ampR-Fc-Pep). The resulting change in phenotype is useful for discriminating recombinant from nonrecombinant clones.

The following description gives the uniform method for carrying out the cloning of all 30 bacterially expressed recombinant proteins exemplified herein. Only the set of oligonucleotides and the vector are varied. These specifications are given below in each example.

An oligonucleotide duplex containing the coding region for a given peptide was formed by annealing the oligonucleotides listed in each example. Ten picomoles of each oligo was mixed in a final volume of 10 μl containing 1× ligation buffer along with 0.3 μg of appropriate vector that had been previously digested with restriction endonuclease BsmBI. The mix was heated to 80° C. and allowed to cool at 0.1 degree/sec to room temperature. To this was added 10 μl of 1× ligase buffer plus 400 units of T4 DNA ligase. The sample was incubated at 14 C for 20 min. Ligase was inactivated by heating at 65° C. for 10 minutes. Next, 10 units of restriction endonucleases BsmBI were added followed by incubation at 55 C for one hour to cleave any reformed parental vector molecules. Fifty ul of chemically competent *E. coli* cells were added and held at 2 C for 20 minutes followed by heat shock at 42 C for 5 second. The entire volume was spread onto Luria Agar plates supplemented with carbenicillin at 200 μg/ml and incubated overnight at 37 C. Colonies were tested for the loss of resistance to the replaceable antibiotic resistance marker. A standard PCR test can be used to confirm the expected size of the duplex insert. Plasmid preparations were obtained and the recombinant insert was verified by DNA sequencing. Half liter cultures of a sequence confirmed construct were grown in Terrific Broth, expression of the peptibody was induced by addition of N-(3-oxo-hexanoyl)-homoserine lactone at 50 ng/ml and after 4-6 hours of shaking at 37 C the cells were centrifuged and the cell paste stored at −20° C.

The following gives for each example the cloning vector and the set of oligonucleotides used for constructing each fusion protein. Also shown is a DNA/protein map.

Bacterial expression of Fc-L-ShK[1-35] inhibitor of Kv1.3. The methods to clone and express the peptibody in bacteria are described above. The vector used was pAMG21ampR-Fc-Pep and the oligos listed below were used to generate a duplex (see below) for cloning and expression in bacteria of Fc-L-ShK[1-35].

Oligos used to form the duplex:

```
TGGTTCCGGTGGTGGTGGTTCCCGTTCCTGCATCGA SEQ ID NO: 669
CACCAT//;

CCCGAAATCCCGTTGCACCGCTTTCCAGTGCAAACA SEQ ID NO: 670
CTCCATGAAATACCGTCTGTCCTTCTGCCGTAAAAC
CTGCGGTACCTGC//;

CTTAGCAGGTACCGCAGGTTTTACGGCAGAAGGACA SEQ ID NO: 671
GACGGT//;

ATTTCATGGAGTGTTTGCACTGGAAAGCGGTGCAAC SEQ ID NO: 672
GGGATTTCGGGATGGTGTCGATGCAGGAACGGGAA
CCACCACCACCGGA//;
```

The oligo duplex is shown below:

```
   TGGTTCCGGTGGTGGTGGTTCCCGTTCCTGCATCGACACCATCCCGAAATCCCGTTGCAC
 1 ---------+---------+---------+---------+---------+---------+  60
       AGGCCACCACCACCAAGGGCAAGGACGTAGCTGTGGTAGGGCTTTAGGGCAACGTG

    G  S  G  G  G  G  S  R  S  C  I  D  T  I  P  K  S  R  C  T  -

   CGCTTTCCAGTGCAAACACTCCATGAAATACCGTCTGTCCTTCTGCCGTAAAACCTGCGG
61 ---------+---------+---------+---------+---------+---------+  120
   GCGAAAGGTCACGTTTGTGAGGTACTTTATGGCAGACAGGAAGACGGCATTTTGGACGCC

    A  F  Q  C  K  H  S  M  K  Y  R  L  S  F  C  R  K  T  C  G  -

    TACCTGC//                                            SEQ ID NO: 673
121 -------
    ATGGACGATTC//                                        SEQ ID NO: 675

    T  C  -//                                            SEQ ID NO: 674
```

Bacterial expression of the peptibody was as described in Example 3 and paste was stored frozen. Purification of bacterially expressed Fc-L10-ShK(1-35) is further described in Example 38 herein below.

Example 4

Fc-L-ShK[2-35] Bacterial Expression

Bacterial expression of Fc-L-ShK[2-35]. The methods to clone and express the peptibody in bacteria are described in Example 3. The vector used was pAMG21ampR-Fc-Pep and the oligos listed below were used to generate a duplex (see below) for cloning and expression in bacteria of Fc-L-ShK [2-35].

Oligos used to form duplex are shown below:

```
TGGTTCCGGTGGTGGTGGTTCCTGCATCGACACCAT SEQ ID NO: 676
CCCGAAATCCCGTTGCACCGCTTTCCAGTGCAAAC
ACTCCATGAAAT//;

ACCGTCTGTCCTTCTGCCGTAAAACCTGCGGTAC   SEQ ID NO: 677
CTGC//;

CTTAGCAGGTACCGCAGGTTTTACGGCAGAAGGA   SEQ ID NO: 678
CAGACGGTATTTCATGGAGTGTTTGCACTGGAAAG
CGGTGCAACGGGA//;

TTTCGGGATGGTGTCGATGCAGGAACCACCACCA   SEQ ID NO: 679
CCGGA//;
```

The oligo duplex formed is shown below:

```
     TGGTTCCGGTGGTGGTGGTTCCTGCATCGACACCATCCCGAAATCCCGTTGCACCGCTTT
   1---------+---------+---------+---------+---------+---------+   60
         AGGCCACCACCACCAAGGACGTAGCTGTGGTAGGGCTTTAGGGCAACGTGGCGAAA

      G  S  G  G  G  G  S  C  I  D  T  I  P  K  S  R  C  T  A  F  -

     CCAGTGCAAACACTCCATGAAATACCGTCTGTCCTTCTGCCGTAAAACCTGCGGTACCTG
  61---------+---------+---------+---------+---------+---------+   120
     GGTCACGTTTGTGAGGTACTTTATGGCAGACAGGAAGACGGCATTTTGGACGCCATGGAC

      Q  C  K  H  S  M  K  Y  R  L  S  F  C  R  K  T  C  G  T  C  - //SEQ ID NO: 681

     C//                                                           SEQ ID NO: 680
 121-
     GATTC//                                                       SEQ ID NO: 682
```

Bacterial expression of the peptibody was as described in Example 3 and paste was stored frozen. Purification of bacterially expressed Fc-L10-ShK(2-35) is further described in Example 39 herein below.

Example 5

Fc-L-HmK Bacterial Expression

Bacterial expression of Fc-L-HmK. The methods to clone and express the peptibody in bacteria are described in Example 3. The vector used was pAMG21ampR-Fc-Pep and the oligos listed below were used to generate a duplex (see below) for cloning and expression in bacteria of Fc-L-HmK.

Oligos used to form duplex are shown below:

```
TGGTTCCGGTGGTGGTGGTTCCCGTACCTGCAAAGA SEQ ID NO: 690
CCTGAT//;

CCCGGTTTCCGAATGCACCGACATCCGTTGCCGTAC SEQ ID NO: 692
CTCCATGAAATACCGTCTGAACCTGTGCCGTAAAAC
CTGCGGTTCCTGC;

CTTAGCAGGAACCGCAGGTTTTACGGCACAGGTTCA SEQ ID NO: 693
GACGGT//;

ATTTCATGGAGGTACGGCAACGGATGTCGGTGCATT SEQ ID NO: 694
CGGAAACCGGGATCAGGTCTTTGCAGGTACGGGAA
CCACCACCACCGGA//
```

The oligo duplex formed is shown below:

```
     TGGTTCCGGTGGTGGTGGTTCCCGTACCTGCAAAGACCTGATCCCGGTTTCCGAATGCAC
   1 ---------+---------+---------+---------+---------+---------+   60
         AGGCCACCACCACCAAGGGCATGGACGTTTCTGGACTAGGGCCAAAGGCTTACGTG

      G  S  G  G  G  G  S  R  T  C  K  D  L  I  P  V  S  E  C  T  -
```

-continued

```
    CGACATCCGTTGCCGTACCTCCATGAAATACCGTCTGAACCTGTGCCGTAAAACCTGCGG
 61---------+---------+---------+---------+---------+---------+  120
    GCTGTAGGCAACGGCATGGAGGTACTTTATGGCAGACTTGGACACGGCATTTTGGACGCC

     D  I  R  C  R  T  S  M  K  Y  R  L  N  L  C  R  K  T  C  G   - //SEQ ID NO: 696

    TTCCTGC//                                                     SEQ ID NO: 695
121---------
    AAGGACGATTC//                                                 SEQ ID NO: 697

     S  C   -
```

Bacterial expression of the peptibody was as described in Example 3 and paste was stored frozen.

Example 6

Fc-L-KTX1 Bacterial Expression

Bacterial expression of Fc-L-KTX1. The methods to clone and express the peptibody in bacteria are described in Example 3. The vector used was pAMG21ampR-Fc-Pep and the oligos listed below were used to generate a duplex (see below) for cloning and expression in bacteria of Fc-L-KTX1. Oligos used to form duplex are shown below:

```
TGGTTCCGGTGGTGGTGGTTCCGGTGTTGAAATCAA SEQ ID NO: 698
CGTTAAATGCT//;

CCGGTTCCCCGCAGTGCCTGAAACCGTGCAAAGAC  SEQ ID NO: 699
GCTGGTATGCGTTTCGGTAAATGCATGAACCGTAAA
TGCCACTGCACCCCGAAA//;

CTTATTTCGGGGTGCAGTGGCATTTACGGTTCATGC SEQ ID NO: 700
ATTTACCGAAA//;

CGCATACCAGCGTCTTTGCACGGTTTCAGGCACTGC SEQ ID NO: 701
GGGGAACCGGAGCATTTAACGTTGATTTCAACACCG
GAACCACCACCACCGGA//;
```

The oligo duplex formed is shown below:

```
    TGGTTCCGGTGGTGGTGGTTCCGGTGTTGAAATCAACGTTAAATGCTCCGGTTCCCCGCA
  1---------+---------+---------+---------+---------+---------+   60
        AGGCCACCACCACCAAGGCCACAACTTTAGTTGCAATTTACGAGGCCAAGGGGCGT

     G  S  G  G  G  G  S  G  V  E  I  N  V  K  C  S  G  S  P  Q   -

    GTGCCTGAAACCGTGCAAAGACGCTGGTATGCGTTTCGGTAAATGCATGAACCGTAAATG
 61---------+---------+---------+---------+---------+---------+  120
    CACGGACTTTGGCACGTTTCTGCGACCATACGCAAAGCCATTTACGTACTTGGCATTTAC

     C  L  K  P  C  K  D  A  G  M  R  F  G  K  C  M  N  R  K  C   -

    CCACTGCACCCCGAAA//                                            SEQ ID NO: 702
121---------+------
    GGTGACGTGGGGCTTTATTC//                                        SEQ ID NO: 704

     H  C  T  P  K   -//                                          SEQ ID NO: 703
```

Bacterial expression of the peptibody was as described in Example 3 and paste was stored frozen.

Purification and refolding of Fc-L-KTX1 expressed in bacteria. Frozen, *E. coli* paste (28 g) was combined with 210 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (4.8 g) was then dissolved in 48 ml 8 M guanidine HCl, 50 mM tris HCl, pH 8.0. The dissolved pellet was then reduced by adding 30 μl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 8.5) at 4° C. with vigorous stirring. The stirring rate was then slowed and the incubation was continued for 2 days at 4° C. The refolding solution was then filtered through a 0.22 μm cellulose acetate filter and stored at 4° C. for 3 days.

The stored refold was then diluted with 1 L of water and the pH was adjusted to 7.5 using 1 M $H_3PO_4$. The pH adjusted material was then loaded on to a 10 ml Amersham SP-HP HiTrap column at 10 ml/min in S-Buffer A (20 mM $NaH_2PO_4$, pH 7.3) at 7° C. The column was then washed with several column volumes of S-Buffer A, followed by elution with a linear gradient from 0% to 60% S-Buffer B (20 mM $NaH_2PO_4$, 1 M NaCl, pH 7.3) followed by a step to 100% S-Buffer B at 5 ml/min 7° C. Fractions were then analyzed using a Coomassie brilliant blue stained tris-glycine 4-20% SDS-PAGE, and the fractions containing the desired product were pooled based on these data (45 ml). The pool was then loaded on to a 1 ml Amersham rProtein A HiTrap column in PBS at 2 ml/min 7° C. Then column was then washed with several column volumes of PBS and eluted with 100 mM glycine pH 3.0. To the elution peak (2.5 ml), 62.5 μl 2 M tris base was added, and then the pH adjusted material was filtered though a Pall Life Sciences Acrodisc with a 0.22 μm, 25 mm Mustang E membrane at 2 ml/min room temperature.

Figure 28A:
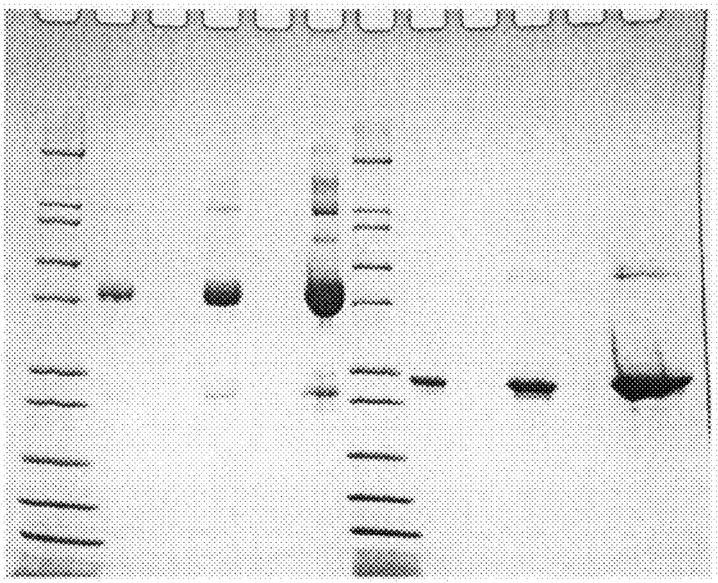
FIG. 28A shows a Coomassie brilliant blue stained tris-glycine 4-20% SDS-PAGE of Fc-L10-KTX1 purified and refolded from bacterial cells. Lane 1-12 are loaded as follows: Novex Mark12 wide range protein standards, 0.5 μg product non-reduced, blank, 2.0 μg product non-reduced, blank, 10 μg product non-reduced, Novex Mark12 wide range protein standards, 0.5 μg product reduced, blank, 2.0 μg product reduced, blank, and 10 μg product reduced.
Figure 28B:
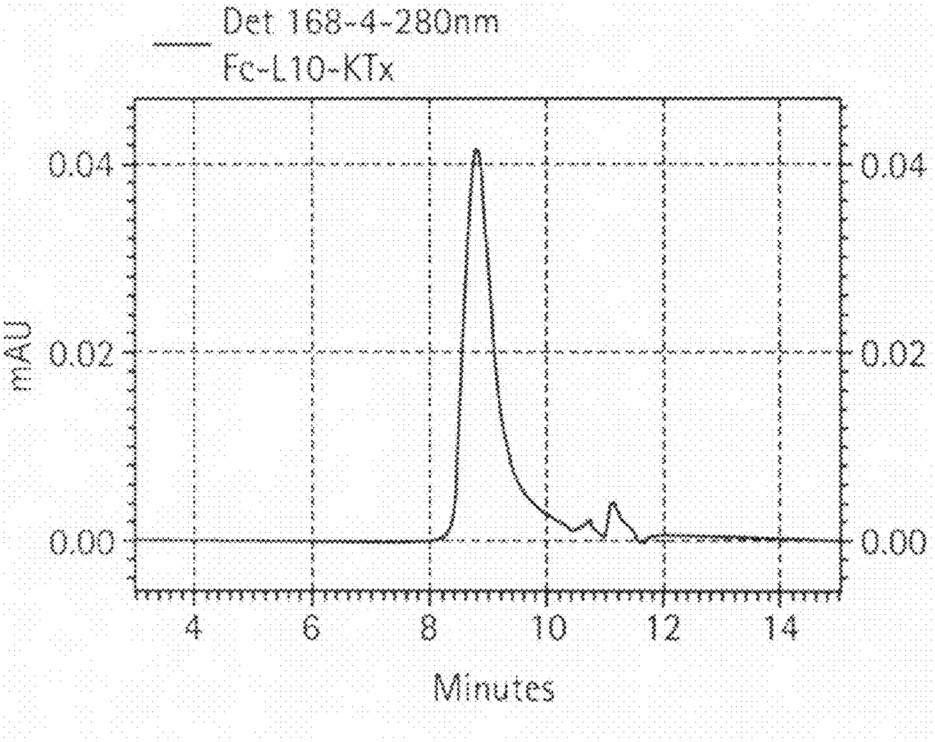
FIG. 28B shows size exclusion chromatography on 45 μg of purified Fc-L10-KTX1 injected on to a Phenomenex BioSep SEC 3000 column (7.8×300 mm) in 50 mM $NaH_2PO_4$, 250 mM NaCl, pH 6.9 at 1 ml/min observing the absorbance at 280 nm.
Figure 28C:
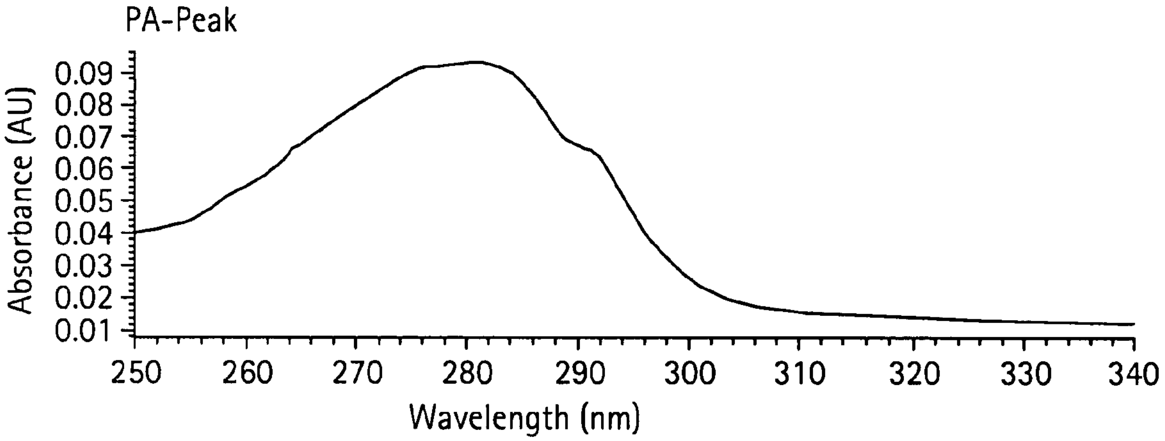
FIG. 28C shows a Spectral scan of 20 μl of the Fc-L10-KTX1 product diluted in 700 μl PBS (blanking buffer) using a Hewlett Packard 8453 spectrophotometer and a 1 cm path length quartz cuvette.
Figure 28D:
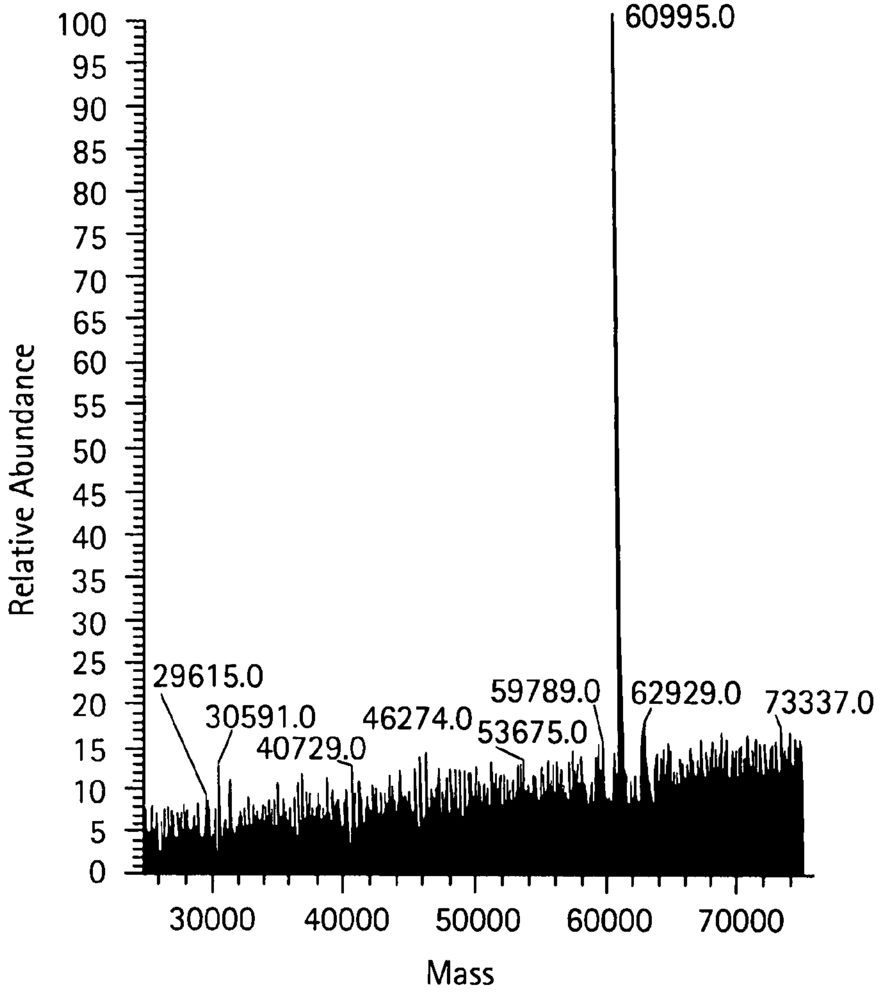
FIG. 28D shows a MALDI mass spectral analysis of the final sample of Fc-L10-KTX1 analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses.

A spectral scan was then conducted on 20 μl of the combined pool diluted in 700 μl PBS using a Hewlett Packard 8453 spectrophotometer (FIG. 28C). The concentration of the filtered material was determined to be 2.49 mg/ml using a calculated molecular mass of 30,504 g/mol and extinction coefficient of 35,410 $M^{-1}$ $cm^{-1}$. The purity of the filtered material was then assessed using a Coomassie brilliant blue stained tris-glycine 4-20% SDS-PAGE (FIG. 28A). The endotoxin level was then determined using a Charles River Laboratories Endosafe-PTS system (0.05-5 EU/ml sensitivity) using a 50-fold dilution of the sample in Charles Rivers Endotoxin Specific Buffer BG120 yielding a result of <1 EU/mg protein. The macromolecular state of the product was then determined using size exclusion chromatography on 45 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 28B). The product was then subject to mass spectral analysis by diluting 1 μl of the sample into 10 μl of sinapinic acid (10 mg per ml in 0.05% trifluoroacetic acid, 50% acetonitrile). The resultant solution (1 μl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 28D) and these studies confirmed the integrity of the purified peptibody, within experimental error. The product was then stored at −80° C.

Purified Fc-L-KTX1 blocked the human Kv1.3 current in a dose-dependent fashion (FIG. 32A and FIG. 32B) by electrophysiology (method was as described in Example 36).

Example 7

Fc-L-HsTx1 Bacterial Expression

Bacterial expression of Fc-L-HsT1. The methods to clone and express the peptibody in bacteria are described in Example 3. The vector used was pAMG21ampR-Fc-Pep and the oligos listed below were used to generate a duplex (see below) for cloning and expression in bacteria of Fc-L-HsTx1.

Oligos used to form duplex are shown below:

```
TGGTTCCGGTGGTGGTGGTTCCGCTTCCTGCCGTA  SEQ ID NO: 705
CCCCGAAAGAC//;

TGCGCTGACCCGTGCCGTAAAGAAACCGGTTGCC   SEQ ID NO: 706
CGTACGGTAAATGCATGAACCGTAAATGCAAATGC
AACCGTTGC//;

CTTAGCAACGGTTGCATTTGCATTTACGGTTCATGC SEQ ID NO: 707
ATTTACCGTACG//;

GGCAACCGGTTTCTTTACGGCACGGGTCAGCGCAGT SEQ ID NO: 708
CTTTCGGGGTACGGCAGGAAGCGGAACCACCACCA
CCGGA//;
```

The duplex formed by the oligos above is shown below:

```
    TGGTTCCGGTGGTGGTGGTTCCGCTTCCTGCCGTACCCCGAAAGACTGCGCTGACCCGTG
  1---------+---------+---------+---------+---------+---------+   60
        AGGCCACCACCACCAAGGCGAAGGACGGCATGGGGCTTTCTGACGCGACTGGGCAC

     G  S  G  G  G  G  S  A  S  C  R  T  P  K  D  C  A  D  P  C  -

    CCGTAAAGAAACCGGTTGCCCGTACGGTAAATGCATGAACCGTAAATGCAAATGCAACCG
 61---------+---------+---------+---------+---------+---------+   120
    GGCATTTCTTTGGCCAACGGGCATGCCATTTACGTACTTGGCATTTACGTTTACGTTGGC

     R  K  E  T  G  C  P  Y  G  K  C  M  N  R  K  C  K  C  N  R  -

    TTGC                                                         SEQ ID NO: 709
121---- 124
    AACGATTC                                                     SEQ ID NO: 711

     C  -                                                        SEQ ID NO: 710
```

Bacterial expression of the peptibody was as described in Example 3 and paste was stored frozen.

Example 8

Fc-L-MgTx Bacterial Expression

Bacterial expression of Fc-L-MgTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-MgTx.

Oligos used to form duplex are shown below:

```
TGGTTCCGGTGGTGGTGGTTCCACCATCATCAACGT SEQ ID NO: 712
TAAATGCACCTC//;

CCCGAAACAGTGCCTGCCGCCGTGCAAAGCTCAGT  SEQ ID NO: 713
TCGGTCAGTCCGCTGGTGCTAAATGCATGAACGGTA
AATGCAAATGCTACCCGCAC//;

CTTAGTGCGGGTAGCATTTGCATTTACCGTTCATGC SEQ ID NO: 714
ATTTAGCACCAG//;

CGGACTGACCGAACTGAGCTTTGCACGGCGGCAGG  SEQ ID NO: 715
CACTGTTTCGGGGAGGTGCATTTAACGTTGATGATG
GTGGAACCACCACCACCGGA//;
```

The oligos above were used to form the duplex shown below:

Bacterial expression of the peptibody was as described in Example 3 and paste was stored frozen.

```
    TGGTTCCGGTGGTGGTGGTTCCACCATCATCAACGTTAAATGCACCTCCCCGAAACAGTG      SEQ ID NO: 716
  1 ---------+---------+---------+---------+---------+---------+   60
        AGGCCACCACCACCAAGGTGGTAGTAGTTGCAATTTACGTGGAGGGGCTTTGTCAC      SEQ ID NO: 718

     G  S  G  G  G  G  S  T  I  I  N  V  K  C  T  S  P  K  Q  C    -  SEQ ID NO: 717

    CCTGCCGCCGTGCAAAGCTCAGTTCGGTCAGTCCGCTGGTGCTAAATGCATGAACGGTAA
 61 ---------+---------+---------+---------+---------+---------+  120
    GGACGGCGGCACGTTTCGAGTCAAGCCAGTCAGGCGACCACGATTTACGTACTTGCCATT

     L  P  P  C  K  A  Q  F  G  Q  S  A  G  A  K  C  M  N  G  K    -

    ATGCAAATGCTACCCGCAC
121 ---------+---------
    TACGTTTACGATGGGCGTGATTC

     C  K  C  Y  P  H  -
```

Bacterial expression of the peptibody was as described in Example 3 and paste was stored frozen.

Example 9

Fc-L-AgTx2 Bacterial Expression

Bacterial expression of Fc-L-AgTx2. The methods to clone and express the peptibody in bacteria are described in Example 3. The vector used was pAMG21ampR-Fc-Pep and the oligos listed below were used to generate a duplex (see below) for cloning and expression in bacteria of Fc-L-AgTx2.

Oligos used to form duplex are shown below:

```
                                            SEQ ID NO: 719
TGGTTCCGGTGGTGGTGGTTCCGGTGTTCCGATCAACGTTTCCTGCACCG
GT //;

                                            SEQ ID NO: 720
TCCCCGCAGTGCATCAAACCGTGCAAAGACGCTGGTATGCGTTTCGGTAA
ATGCATGAACCGTAAATGCCACTGCACCCCGAAA //;

                                            SEQ ID NO: 721
CTTATTTCGGGGTGCAGTGGCATTTACGGTTCATGCATTTACCGAAACGC
ATA //;

                                            SEQ ID NO: 722
CCAGCGTCTTTGCACGGTTTGATGCACTGCGGGGAACCGGTGCAGGAAAC
GTTGATCGGAACACCGGAACCACCACCACCGGA //;
```

The oligos listed above were used to form the duplex shown below:

Refolding and purification of Fc-L-AgTx2 expressed in bacteria. Frozen, *E. coli* paste (15 g) was combined with 120 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (4.6 g) was then dissolved in 46 ml 8 M guanidine HCl, 50 mM tris HCl, pH 8.0. The dissolved pellet was then reduced by adding 30 μl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then filtered through a 0.22 μm cellulose acetate filter and stored at −70° C.

The stored refold was defrosted and then diluted with 1 L of water and the pH was adjusted to 7.5 using 1 M $H_3PO_4$. The pH adjusted material was then filtered through a 0.22 μm

```
    TGGTTCCGGTGGTGGTGGTTCCGGTGTTCCGATCAACGTTTCCTGCACCGGTTCCCCGCA      SEQ ID NO: 723
  1 ---------+---------+---------+---------+---------+---------+   60
        AGGCCACCACCACCAAGGCCACAAGGCTAGTTGCAAAGGACGTGGCCAAGGGGCGT      SEQ ID NO: 725

     G  S  G  G  G  G  S  G  V  P  I  N  V  S  C  T  G  S  P  Q    -  SEQ ID NO: 724

    GTGCATCAAACCGTGCAAAGACGCTGGTATGCGTTTCGGTAAATGCATGAACCGTAAATG
 61 ---------+---------+---------+---------+---------+---------+  120
    CACGTAGTTTGGCACGTTTCTGCGACCATACGCAAAGCCATTTACGTACTTGGCATTTAC

     C  I  K  P  C  K  D  A  G  M  R  F  G  K  C  M  N  R  K  C    -

    CCACTGCACCCCGAAA_
121 ---------+------
    GGTGACGTGGGGCTTTATTC

     H  C  T  P  K  -
```

cellulose acetate filter and loaded on to a 10 ml Amersham SP-HP HiTrap column at 10 ml/min in S-Buffer A (20 mM NaH$_2$PO$_4$, pH 7.3) at 7° C. The column was then washed with several column volumes of S-Buffer A, followed by elution with a linear gradient from 0% to 60% S-Buffer B (20 mM NaH$_2$PO$_4$, 1 M NaCl, pH 7.3) followed by a step to 100% S-Buffer B at 5 ml/min 7° C. Fractions were then analyzed using a Coomassie brilliant blue stained tris-glycine 4-20% SDS-PAGE, and the fractions containing the desired product were pooled based on these data (15 ml). The pool was then loaded on to a 1 ml Amersham rProtein A HiTrap column in PBS at 2 ml/min 7° C. Then column was then washed with several column volumes of 20 mM NaH$_2$PO$_4$ pH 6.5, 1 M NaCl and eluted with 100 mM glycine pH 3.0. To the elution peak (1.5 ml), 70 µl 1 M tris HCl pH 8.5 was added, and then the pH-adjusted material was filtered though a 0.22 µm cellulose acetate filter.

A spectral scan was then conducted on 20 µl of the combined pool diluted in 700 µl PBS using a Hewlett Packard 8453 spectrophotometer (FIG. 29C). The concentration of the filtered material was determined to be 1.65 mg/ml using a calculated molecular mass of 30,446 g/mol and extinction coefficient of 35,410 M$^{-1}$ cm$^{-1}$. The purity of the filtered material was then assessed using a Coomassie brilliant blue stained tris-glycine 4-20% SDS-PAGE (FIG. 29A). The endotoxin level was then determined using a Charles River Laboratories Endosafe-PTS system (0.05-5 EU/ml sensitivity) using a 33-fold dilution of the sample in Charles Rivers Endotoxin Specific Buffer BG120 yielding a result of <4 EU/mg protein. The macromolecular state of the product was then determined using size exclusion chromatography on 20 µg of the product injected on to a Phenomenex BioSep SEC 3000 column (7.8×300 mm) in 50 mM NaH$_2$PO$_4$, 250 mM NaCl, pH 6.9 at 1 ml/min observing the absorbance at 280 nm (FIG. 29D). The product was then subject to mass spectral analysis by diluting 1 µl of the sample into 10 µL of sinapinic acid (10 mg per ml in 0.05% trifluoroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 29E) and these studies confirmed the integrity of the purified peptibody, within experimental error. The product was then stored at −80° C.

Example 10

Fc-L-OSK1 Bacterial Expression

Bacterial expression of Fc-L-OSK1. The methods used to clone and express the peptibody in bacteria were as described in Example 3. The vector used was pAMG21ampR-Fc-Pep and the oligos listed below were used to generate a duplex (see below) for cloning and expression in bacteria of Fc-L-OSK1.

Oligos used to form duplex are shown below:

```
                                                   SEQ ID NO: 726
TGGTTCCGGTGGTGGTGGTTCCGGTGTTATCATCAACGTTAAATGCAAAA
TCTCCCGTCAGTGCCTGGAACCGTGCAAAAAAG //;

                                                   SEQ ID NO: 727
CTGGTATGCGTTTCGGTAAATGCATGAACGGTAAATGCCACTGCACCCCG
AAA //;

                                                   SEQ ID NO: 728
CTTATTTCGGGGTGCAGTGGCATTTACCGTTCATGCATTTACCGAAACGC
ATACCAGCTTTTTTGCACGGTTCCAGGCACTGA //;

                                                   SEQ ID NO: 729
CGGGAGATTTTGCATTTAACGTTGATGATAACACCGGAACCACCACCACC
GGA //;
```

The oligos shown above were used to form the duplex below:

```
      TGGTTCCGGTGGTGGTGGTTCCGGTGTTATCATCAACGTTAAATGCAAAATCTCCCGTCA       SEQ ID NO: 730
  1   ---------+---------+---------+---------+---------+---------+   60
      AGGCCACCACCACCAAGGCCACAATAGTAGTTGCAATTTACGTTTTAGAGGGCAGT          SEQ ID NO: 732

      G  S  G  G  G  G  S  G  V  I  I  N  V  K  C  K  I  S  R  Q   -  SEQ ID NO: 731

      GTGCCTGGAACCGTGCAAAAAAGCTGGTATGCGTTTCGGTAAATGCATGAACGGTAAATG
 61   ---------+---------+---------+---------+---------+---------+   120
      CACGGACCTTGGCACGTTTTTTCGACCATACGCAAAGCCATTTACGTACTTGCCATTTAC

      C  L  E  P  C  K  K  A  G  M  R  F  G  K  C  M  N  G  K  C    -

      CCACTGCACCCCGAAA
121   ---------+------
      GGTGACGTGGGGCTTTATTC

      H  C  T  P  K    -
```

Bacterial expression of the peptibody was as described in Example 3 and paste was stored frozen for later use. Purification of Fc-L10-OSK1 from *E. coli* paste is described in Example 40 herein below.

Example 11

Fc-L-OSK1(E16K, K20D) Bacterial Expression

Bacterial expression of Fc-L-OSK1(E16K, K20D). The methods to clone and express the peptibody in bacteria are described in Example 3. The vector used was pAMG21ampR-Fc-Pep the oligos listed below were used to generate a duplex (see below) for cloning and expression in bacteria of Fc-L-OSK1(E16K,K20D).

Oligos used to form duplex are shown below:

```
                                                   SEQ ID NO:733
TGGTTCCGGTGGTGGTGGTTCCGGTGTTATCATCAACGTTAAATGCAAAA
TCTCCCGTCAGTGCCTGAAACCGTGCAAAGACG //;
```

-continued

SEQ ID NO: 734
CTGGTATGCGTTTCGGTAAATGCATGAACGGTAAATGCCACTGCACCCCG
AAA //;

SEQ ID NO: 735
CTTATTTCGGGGTGCAGTGGCATTTACCGTTCATGCATTTACCGAAACGC
ATACCAGCGTCTTTGCACGGTTTCAGGCACTGA //;

SEQ ID NO: 736
CGGGAGATTTTGCATTTAACGTTGATGATAACACCGGAACCACCACCACC
GGA //;

The oligos shown above were used to form the duplex below:

```
    TGGTTCCGGTGGTGGTGGTTCCGGTGTTATCATCAACGTTAAATGCAAAATCTCCCGTCA      SEQ ID NO: 737
  1 ---------+---------+---------+---------+---------+---------+   60
        AGGCCACCACCACCAAGGCCACAATAGTAGTTGCAATTTACGTTTTAGAGGGCAGT      SEQ ID NO: 739

     G  S  G  G  G  G  S  G  V  I  I  N  V  K  C  K  I  S  R  Q     -  SEQ ID NO: 738

    GTGCCTGAAACCGTGCAAAGACGCTGGTATGCGTTTCGGTAAATGCATGAACGGTAAATG
 61 ---------+---------+---------+---------+---------+---------+   120
    CACGGACTTTGGCACGTTTCTGCGACCATACGCAAAGCCATTTACGTACTTGCCATTTAC

     C  L  K  P  C  K  D  A  G  M  R  F  G  K  C  M  N  G  K  C     -

    CCACTGCACCCCGAAA
121 ---------+------
    GGTGACGTGGGGCTTTATTC

     H  C  T  P  K  -
```

Bacterial expression of the peptibody was as described in Example 3 and paste was stored frozen for later use.

Example 12

Fc-L-Anuroctoxin Bacterial Expression

Bacterial expression of Fc-L-Anuroctoxin. The methods to clone and express the peptibody in bacteria are described in Example 3. The vector used was pAMG21ampR-Fc-Pep and the oligos listed below were used to generate a duplex (see below) for cloning and expression in bacteria of Fc-L-Anuroctoxin.

Oligos used to form duplex are shown below:

SEQ ID NO: 740
TGGTTCCGGTGGTGGTGGTTCCAAAGAATGCACCGGTCCGCAGCACTGCA
CCAACTTCTGCCGTAAAAACAAATGCACCCACG //;

SEQ ID NO: 741
GTAAATGCATGAACCGTAAATGCAAATGCTTCAACTGCAAA //;

SEQ ID NO: 742
CTTATTTGCAGTTGAAGCATTTGCATTTACGGTTCATGCATTTACCGTGG
GTGCATTTGTTTTTACGGCAGAAGTTGGTGCAG //;

SEQ ID NO: 743
TGCTGCGGACCGGTGCATTCTTTGGAACCACCACCACCGGA //;

The oligos shown above were used to form the duplex below:

```
    TGGTTCCGGTGGTGGTGGTTCCAAAGAATGCACCGGTCCGCAGCACTGCACCAACTTCTG       SEQ ID NO: 744
  1 ---------+---------+---------+---------+---------+---------+   60
        AGGCCACCACCACCAAGGTTTCTTACGTGGCCAGGCGTCGTGACGTGGTTGAAGAC       SEQ ID NO: 746

     G  S  G  G  G  G  S  K  E  C  T  G  P  Q  H  C  T  N  F  C    -  SEQ ID NO: 745

    CCGTAAAAACAAATGCACCCACGGTAAATGCATGAACCGTAAATGCAAATGCTTCAACTG
 61 ---------+---------+---------+---------+---------+---------+   120
    GGCATTTTTGTTTACGTGGGTGCCATTTACGTACTTGGCATTTACGTTTACGAAGTTGAC

     R  K  N  K  C  T  H  G  K  C  M  N  R  K  C  K  C  F  N  C    -

    CAAA
121 ----
    GTTTATTC

     K   -
```

Bacterial expression of the peptibody was as described in Example 3 and paste was stored frozen.

Example 13

Fc-L-Noxiustoxin Bacterial Expression

Bacterial expression of Fc-L-Noxiustoxin or Fc-L-NTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-NTX.

Oligos used to form duplex are shown below:

```
                                                 SEQ ID NO: 747
TGGTTCCGGTGGTGGTGGTTCCACCATCATCAACGTTAAATGCACCTCCC
CGAAACAGTGCTCCAAACCGTGCAAAGAACTGT //;

                                                 SEQ ID NO: 748
ACGGTTCCTCCGCTGGTGCTAAATGCATGAACGGTAAATGCAAATGCTAC
AACAAC //;

                                                 SEQ ID NO: 749
CTTAGTTGTTGTAGCATTTGCATTTACCGTTCATGCATTTAGCACCAGCG
GAGGAACCGTACAGTTCTTTGCACGGTTTGGAG //;

                                                 SEQ ID NO: 750
CACTGTTTCGGGGAGGTGCATTTAACGTTGATGATGGTGGAACCACCACC
ACCGGA //;
```

The oligos shown above were used to form the duplex below:

```
    TGGTTCCGGTGGTGGTGGTTCCACCATCATCAACGTTAAATGCACCTCCCCGAAACAGTG       SEQ ID NO: 751
  1 ---------+---------+---------+---------+---------+---------+   60
        AGGCCACCACCACCAAGGTGGTAGTAGTTGCAATTTACGTGGAGGGGCTTTGTCAC       SEQ ID NO: 753
     G  S  G  G  G  G  S  T  I  I  N  V  K  C  T  S  P  K  Q  C    -  SEQ ID NO: 752

    CTCCAAACCGTGCAAAGAACTGTACGGTTCCTCCGCTGGTGCTAAATGCATGAACGGTAA
 61 ---------+---------+---------+---------+---------+---------+   120
    GAGGTTTGGCACGTTTCTTGACATGCCAAGGAGGCGACCACGATTTACGTACTTGCCATT

     S  K  P  C  K  E  L  Y  G  S  S  A  G  A  K  C  M  N  G  K    -

    ATGCAAATGCTACAACAAC
121 ---------+---------
    TACGTTTACGATGTTGTTGATTC

     C  K  C  Y  N  N   -
```

Bacterial expression of the peptibody was as described in Example 3 and paste was stored frozen.

Example 14

Fc-L-Pi2 Bacterial Expression

Bacterial expression of Fc-L-Pi2. The methods to clone and express the peptibody in bacteria are described in Example 3. The vector used was pAMG21ampR-Fc-Pep and the oligos listed below were used to generate a duplex (see below) for cloning and expression in bacteria of Fc-L-Pi2.

Oligos used to form duplex are shown below:

```
                                                 SEQ ID NO: 754
TGGTTCCGGTGGTGGTGGTTCCACCATCTCCTGCACCAACCCG //;

                                                 SEQ ID NO: 755
AAACAGTGCTACCCGCACTGCAAAAAAGAAACCGGTTACCCGAACGCTAA
ATGCATGAACCGTAAATGCAAATGCTTCGGTCGT //;

                                                 SEQ ID NO: 756
CTTAACGACCGAAGCATTTGCATTTACGGTTCATGCATTTAGCG //;

                                                 SEQ ID NO: 757
TTCGGGTAACCGGTTTCTTTTTTGCAGTGCGGGTAGCACTGTTTCGGGTT
GGTGCAGGAGATGGTGGAACCACCACCACCGGA //;
```

The oligos above were used to form the duplex below:

```
    TGGTTCCGGTGGTGGTGGTTCCACCATCTCCTGCACCAACCCGAAACAGTGCTACCCGCA      SEQ ID NO: 758
  1 ---------+---------+---------+---------+---------+---------+   60
        AGGCCACCACCACCAAGGTGGTAGAGGACGTGGTTGGGCTTTGTCACGATGGGCGT      SEQ ID NO: 760

     G  S  G  G  G  G  S  T  I  S  C  T  N  P  K  Q  C  Y  P  H    - SEQ ID NO: 759

    CTGCAAAAAAGAAACCGGTTACCCGAACGCTAAATGCATGAACCGTAAATGCAAATGCTT
 61 ---------+---------+---------+---------+---------+---------+   120
    GACGTTTTTTCTTTGGCCAATGGGCTTGCGATTTACGTACTTGGCATTTACGTTTACGAA

     C  K  K  E  T  G  Y  P  N  A  K  C  M  N  R  K  C  K  C  F    -

    CGGTCGT
121 -------
    GCCAGCAATTC

     G  R   -
```

Bacterial expression of the peptibody was as described in Example 3 and paste was stored frozen.

Example 15

ShK[1-35]-L-Fc Bacterial Expression

Bacterial expression of ShK[1-35]-L-Fc. The methods to clone and express the peptibody in bacteria are described in Example 3. The vector used was pAMG21ampR-Pep-Fc and the oligos listed below were used to generate a duplex (see below) for cloning and expression in bacteria of ShK[1-35]-L-Fc.

Oligos used to form duplex are shown below:

```
                                               SEQ ID NO: 761
TATGCGTTCTTGTATTGATACTATTCCAAAATCTCGTTGTACTGCTTTTC
AATGTAAACATTCTATGAAATATCGTCTTTCTT //;

                                               SEQ ID NO: 762
TTTGTCGTAAAACTTGTGGTACTTGTTCTGGTGGTGGTGGTTCT //;

                                               SEQ ID NO: 763
CACCAGAACCACCACCACCAGAACAAGTACCACAAGTTTTACGACAAAAA
GAAAGACGATATTTCATAGAATGTTTACATTGA //;

                                               SEQ ID NO: 764
AAAGCAGTACAACGAGATTTTGGAATAGTATCAATACAAGAACG //;
```

The oligos shown above were used to form the duplex shown below:

```
    TATGCGTTCTTGTATTGATACTATTCCAAAATCTCGTTGTACTGCTTTTCAATGTAAACA      SEQ ID NO: 765
  1 ---------+---------+---------+---------+---------+---------+   60
        GCAAGAACATAACTATGATAAGGTTTTAGAGCAACATGACGAAAAGTTACATTTGT      SEQ ID NO: 767

     M  R  S  C  I  D  T  I  P  K  S  R  C  T  A  F  Q  C  K  H    - SEQ ID NO: 766

    TTCTATGAAATATCGTCTTTCTTTTTGTCGTAAAACTTGTGGTACTTGTTCTGGTGGTGG
 61 ---------+---------+---------+---------+---------+---------+   120
    AAGATACTTTATAGCAGAAAGAAAAACAGCATTTTGAACACCATGAACAAGACCACCACC

     S  M  K  Y  R  L  S  F  C  R  K  T  C  G  T  C  S  G  G  G    -

    TGGTTCT
121 -------                                                        127
    ACCAAGACCAC

     G  S   -
```

Bacterial expression of the peptibody was as described in Example 3 and paste was stored frozen. Purification of met-ShK[1-35]-Fc was as described in Example 51 herein below.

Example 16

ShK[2-35]-L-Fc Bacterial Expression

Bacterial expression of ShK[2-35]-L-Fc. The methods to clone and express the peptibody in bacteria are described in Example 3. The vector used was pAMG21ampR-Pep-Fc and the oligos listed below were used to generate a duplex (see below) for cloning and expression in bacteria of ShK[2-35]-L-Fc.

Oligos used to form duplex are shown below:

```
TATGTCTTGTATTGATACTATTCCAAAATCT     SEQ ID NO: 768
CGTTGTACTGCTTTTCAATGTAAACATTCT
ATGAAATATCGTCTTTCTT//;

TTTGTCGTAAAACTTGTGGTACTTGTTCTGGT    SEQ ID NO: 769
GGTGGTGGTTCT//;

CACCAGAACCACCACCACCAGAACAAGTA       SEQ ID NO: 770
CCACAAGTTTTACGACAAAAAGAAAGACGA
TATTTCATAGAATGTTTACATTGA//;

AAAGCAGTACAACGAGATTTTGGAATAGTA      SEQ ID NO: 771
TCAATACAAGA;
```

The oligos above were used to form the duplex shown below:

```
    TATGTCTTGTATTGATACTATTCCAAAATCTCGTTGTACTGCTTTTCAATGTAAACATTC
  1---------+---------+---------+---------+---------+---------+   60
        AGAACATAACTATGATAAGGTTTTAGAGCAACATGACGAAAAGTTACATTTGTAAG
      M  S  C  I  D  T  I  P  K  S  R  C  T  A  F  Q  C  K  H  S  -

    TATGAAATATCGTCTTTCTTTTTGTCGTAAAACTTGTGGTACTTGTTCTGGTGGTGGTGG
 61---------+---------+---------+---------+---------+---------+  120
    ATACTTTATAGCAGAAAGAAAAACAGCATTTTGAACACCATGAACAAGACCACCACCACC
      M  K  Y  R  L  S  F  C  R  K  T  C  G  T  C  S  G  G  G  G  -

    TTCT                                                    SEQ ID NO: 772
121----
    AAGACCAC                                                SEQ ID NO: 774
      S   -                                                 SEQ ID NO: 773
```

Bacterial expression of the peptibody was as described in Example 3 and paste was stored frozen. Purification of the ShK[2-35]-Fc was as described in Example 50 herein below.

Example 17

Fc-L-ChTx Bacterial Expression

Bacterial expression of Fc-L-ChTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-ChTx.

Oligos used to form duplex are shown below:

```
TGGTTCCGGTGGTGGTGGTTCCCAGTTCACC     SEQ ID NO: 775
AACGTT//;

TCCTGCACCACCTCCAAAGAATGCTGGTCCG     SEQ ID NO: 776
TTTGCCAGCGTCTGCACAACACCTCCCGTGGT
AAATGCATGAACAAAAAATGCCGTTGCTACTCC;

CTTAGGAGTAGCAACGGCATTTTTTGTTCATGC   SEQ ID NO: 777
ATTTA//;

CCACGGGAGGTGTTGTGCAGACGCTGGCAAA     SEQ ID NO: 778
CGGACCAGCATTCTTTGGAGGTGGTGCAGGA
AACGTTGGTGAACTGGGAACCACCACCACC
GGA//;
```

The oligos shown above were used to form the duplex below:

```
    TGGTTCCGGTGGTGGTGGTTCCCAGTTCACCAACGTTTCCTGCACCACCTCCAAAGAATG
  1---------+---------+---------+---------+---------+---------+   60
        AGGCCACCACCACCAAGGGTCAAGTGGTTGCAAAGGACGTGGTGGAGGTTTCTTAC
      G  S  G  G  G  G  S  Q  F  T  N  V  S  C  T  T  S  K  E  C  -

    CTGGTCCGTTTGCCAGCGTCTGCACAACACCTCCCGTGGTAAATGCATGAACAAAAAATG
 61---------+---------+---------+---------+---------+---------+  120
    GACCAGGCAAACGGTCGCAGACGTGTTGTGGAGGGCACCATTTACGTACTTGTTTTTTAC
      W  S  V  C  Q  R  L  H  N  T  S  R  G  K  C  M  N  K  K  C  -

    CCGTTGCTACTCC                                           SEQ ID NO: 779
121---------+---
    GGCAACGATGAGGATTC                                       SEQ ID NO: 781
      R  C  Y  S   -                                        SEQ ID NO: 780
```

Bacterial expression of the peptibody was as described in Example 3 and paste was stored frozen.

Example 18

Fc-L-MTX Bacterial Expression

Bacterial expression of Fc-L-MTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-MTX.

Oligos used to form duplex are shown below:

```
TGGTTCCGGTGGTGGTGGTTCGGTTTCCTGCA    SEQ ID NO: 782
CCGGT//;

TCCAAAGACTGCTACGCTCCGTGCCGTAAACA    SEQ ID NO: 783
GACCGGTTGCCCGAACGCTAAATGCATCAACA
AATCCTGCAAATGCTACGGTTGC//;

CTTAGCAACCGTAGCATTTGCAGGATTTGTTGAT  SEQ ID NO: 784
GCAT//;

TTAGCGTTCGGGCAACCGGTCTGTTTACGGCAC   SEQ ID NO: 785
GGAGCGTAGCAGTCTTTGGAACCGGTGCAGGA
AACGGAACCACCACCACCGGA//;
```

The oligos above were used to form the duplex shown below:

```
   TGGTTCCGGTGGTGGTGGTTCCGTTTCCTGCACCGGTTCCAAAGACTGCTACGCTCCGTG
 1---------+---------+---------+---------+---------+---------+   60
       AGGCCACCACCACCAAGGCAAAGGACGTGGCCAAGGTTTCTGACGATGCGAGGCAC
    G  S  G  G  G  G  S  V  S  C  T  G  S  K  D  C  Y  A  P  C  -

   CCGTAAACAGACCGGTTGCCCGAACGCTAAATGCATCAACAAATCCTGCAAATGCTACGG
61---------+---------+---------+---------+---------+---------+  120
   GGCATTTGTCTGGCCAACGGGCTTGCGATTTACGTAGTTGTTTAGGACGTTTACGATGCC
    R  K  Q  T  G  C  P  N  A  K  C  I  N  K  S  C  K  C  Y  G  -

   TTGC                                                         SEQ ID NO: 786
121----
   AACGATTC                                                     SEQ ID NO: 788
    C   -                                                       SEQ ID NO: 787
```

Bacterial expression of the peptibody was as described in Example 3 and paste was stored frozen.

Example 19

Fc-L-ChTx (K32E) Bacterial Expression

Bacterial expression of Fc-L-ChTx (K32E). The methods to clone and express the peptibody in bacteria are described in Example 3. The vector used was pAMG21ampR-Fc-Pep and the oligos listed below were used to generate a duplex (see below) for cloning and expression in bacteria of Fc-L-ChTx (K32E).

Oligos used to form duplex are shown below:

```
TGGTTCCGGTGGTGGTGGTTCCCAGTTCACCA   SEQ ID NO: 789
ACGTTTCCTG//;

CACCACCTCCAAAGAATGCTGGTCCGTTTGCC   SEQ ID NO: 790
AGCGTCTGCACAACACCTCCCGTGGTAAATGC
ATGAACAAAGAATGCCGTTGCTACTCC//;

CTTAGGAGTAGCAACGGCATTCTTTGTTCATGCA SEQ ID NO: 791
TTTACCACG//;

GGAGGTGTTGTGCAGACGCTGGCAAACGGACCA  SEQ ID NO: 792
GCATTCTTTGGAGGTGGTGCAGGAAACGTTGGTG
AACTGGGAACCACCACCACCGGA//;
```

The oligos shown above were used to form the duplex below:

```
    TGGTTCCGGTGGTGGTGGTTCCCAGTTCACCAACGTTTCCTGCACCACCTCCAAAGAATG
 1 ---------+---------+---------+---------+---------+---------+   60
        AGGCCACCACCACCAAGGGTCAAGTGGTTGCAAAGGACGTGGTGGAGGTTTCTTAC
     G  S  G  G  G  G  S  Q  F  T  N  V  S  C  T  T  S  K  E  C  -

    CTGGTCCGTTTGCCAGCGTCTGCACAACACCTCCCGTGGTAAATGCATGAACAAAGAATG
61 ---------+---------+---------+---------+---------+---------+  120
    GACCAGGCAAACGGTCGCAGACGTGTTGTGGAGGGCACCATTTACGTACTTGTTTCTTAC
     W  S  V  C  Q  R  L  H  N  T  S  R  G  K  C  M  N  K  E  C  -

    CCGTTGCTACTCC                                               SEQ ID NO: 793
121 ---------+---
    GGCAACGATGAGGATTC                                           SEQ ID NO: 795
     R  C  Y  S  -                                              SEQ ID NO: 794
```

Bacterial expression of the peptibody was as described in Example 3 and paste was stored frozen.

Example 20

Fc-L-Apamin Bacterial Expression

Bacterial expression of Fc-L-Apamin. The methods to clone and express the peptibody in bacteria are described in Example 3. The vector used was pAMG21ampR-Fc-Pep and the oligos listed below were used to generate a duplex (see below) for cloning and expression in bacteria of Fc-L-Apamin.

Oligos used to form duplex are shown below:

```
TGGTTCCGGTGGTGGTGGTTCCTGCAACTGCA   SEQ ID NO: 796
AAGCTCCGGAAACCGCTCTGTGCGCTCGTCG
TTGCCAGCAGCACGGT//;

CTTAACCGTGCTGCTGGCAACGACGAGCGCA    SEQ ID NO: 797
CAGAGCGGTTTCCGGAGCTTTGCAGTTGCAGG
AACCACCACCACCGGA//;
```

The oligos above were used to form the duplex shown below:

```
   TGGTTCCGGTGGTGGTGGTTCCTGCAACTGCAAAGCTCCGGAAACCGCTCTGTGCGCTCG
 1 ---------+---------+---------+---------+---------+---------+  60
       AGGCCACCACCACCAAGGACGTTGACGTTTCGAGGCCTTTGGCGAGACACGCGAGC
    G  S  G  G  G  G  S  C  N  C  K  A  P  E  T  A  L  C  A  R  -

   TCGTTGCCAGCAGCACGGT                                        SEQ ID NO: 798
61 ---------+---------
   AGCAACGGTCGTCGTGCCAATTC                                    SEQ ID NO: 800
    R  C  Q  Q  H  G  -                                       SEQ ID NO: 799
```

Bacterial expression of the peptibody was as described in Example 3 and paste was stored frozen.

Example 21

Fc-L-Scyllatoxin Bacterial Expression

Bacterial expression of Fc-L-Scyllatoxin or Fc-L-ScyTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-ScyTx.

Oligos used to form duplex are shown below:

```
TGGTTCCGGTGGTGGTGGTTCCGCTTTCTGCA   SEQ ID NO: 801
ACCTGCG//;

TATGTGCCAGCTGTCCTGCCGTTCCCTGGGTC   SEQ ID NO: 802
TGCTGGGTAAATGCATCGGTGACAAATGCGAA
TGCGTTAAACAC//;

CTTAGTGTTTAACGCATTCGCATTTGTCACCGAT SEQ ID NO: 803
GCATTT//;

ACCCAGCAGACCCAGGGAACGGCAGGACAGC    SEQ ID NO: 804
TGGCACATACGCAGGTTGCAGAAAGCGGAACC
ACCACCACCGGA//;
```

The oligos above were used to form the duplex below:

```
   TGGTTCCGGTGGTGGTGGTTCCGCTTTCTGCAACCTGCGTATGTGCCAGCTGTCCTGCCG
 1 ---------+---------+---------+---------+---------+---------+  60
       AGGCCACCACCACCAAGGCGAAAGACGTTGGACGCATACACGGTCGACAGGACGGC
    G  S  G  G  G  G  S  A  F  C  N  L  R  M  C  Q  L  S  C  R  -

   TTCCCTGGGTCTGCTGGGTAAATGCATCGGTGACAAATGCGAATGCGTTAAACAC    SEQ ID NO: 805
61 ---------+---------+---------+---------+---------+--------
   AAGGGACCCAGACGACCCATTTACGTAGCCACTGTTTACGCTTACGCAATTTGTGATTC  SEQ ID NO: 807
    S  L  G  L  L  G  K  C  I  G  D  K  C  E  C  V  K  H  -   SEQ ID NO: 806
```

Bacterial expression of the peptibody was as described in Example 3 and paste was stored frozen.

Example 22

Fc-L-IbTx Bacterial Expression

Bacterial expression of Fc-L-IbTx. The methods to clone and express the peptibody in bacteria are described in Example 3. The vector used was pAMG21ampR-Fc-Pep and the oligos listed below were used to generate a duplex (see below) for cloning and expression in bacteria of Fc-L-IbTx.

Oligos used to form duplex are shown below:

```
TGGTTCCGGTGGTGGTGGTTCCCAGTTCACCG   SEQ ID NO: 808
ACGTTGACTGCTCCGT//;

TTCCAAAGAATGCTGGTCCGTTTGCAAAGACC   SEQ ID NO: 809
TGTTCGGTGTTGACCGTGGTAAATGCATGGGTA
AAAAATGCCGTTGCTACCAG//;

CTTACTGGTAGCAACGGCATTTTTTACCCATGCA SEQ ID NO: 810
TTTACCACGGTCAA//;

CACCGAACAGGTCTTTGCAAACGGACCAGCATT  SEQ ID NO: 811
CTTTGGAAACGGAGCAGTCAACGTCGGTGAACT
GGGAACCACCACCACCGGA//;
```

The oligos above were used to form the duplex below:

```
    TGGTTCCGGTGGTGGTGGTTCCCAGTTCACCGACGTTGACTGCTCCGTTTCCAAAGAATG
  1 ---------+---------+---------+---------+---------+---------+  60
        AGGCCACCACCACCAAGGGTCAAGTGGCTGCAACTGACGAGGCAAAGGTTTCTTAC
     G  S  G  G  G  G  S  Q  F  T  D  V  D  C  S  V  S  K  E  C   -

    CTGGTCCGTTTGCAAAGACCTGTTCGGTGTTGACCGTGGTAAATGCATGGGTAAAAAATG
 61 ---------+---------+---------+---------+---------+---------+  120
    GACCAGGCAAACGTTTCTGGACAAGCCACAACTGGCACCATTTACGTACCCATTTTTTAC
     W  S  V  C  K  D  L  F  G  V  D  R  G  K  C  M  G  K  K  C   -

    CCGTTGCTACCAG                                                 SEQ ID NO: 812
121 ---------+---
    GGCAACGATGGTCATTC                                             SEQ ID NO: 814
     R  C  Y  Q   -                                               SEQ ID NO: 813
```

Bacterial expression of the peptibody was as described in Example 3 and paste was stored frozen.

Example 23

Fc-L-HaTx1 Bacterial Expression

Bacterial expression of Fc-L-HaTx1. The methods to clone and express the peptibody in bacteria are described in Example 3. The vector used was pAMG21ampR-Fc-Pep and the oligos listed below were used to generate a duplex (see below) for cloning and expression in bacteria of Fc-L-HaTx1.

Oligos used to form duplex are shown below:

```
TGGTTCCGGTGGTGGTGGTTCCGAATGCCGTT   SEQ ID NO: 815
ACCTGTTCGGTGGTTG//;

CAAAACCACCTCCGACTGCTGCAAACACCTG    SEQ ID NO: 816
GGTTGCAAATTCCGTGACAAATACTGCGCTTG
GGACTTCACCTTCTCC//;

CTTAGGAGAAGGTGAAGTCCCAAGCGCAGTAT   SEQ ID NO: 817
TTGTCACGGAATTTGC//;

AACCCAGGTGTTTGCAGCAGTCGGAGGTGGTT   SEQ ID NO: 818
TTGCAACCACCGAACAGGTAACGGCATTCGGA
ACCACCACCACCGGA//;
```

The oligos above were used to form the duplex below:

```
   TGGTTCCGGTGGTGGTGGTTCCGAATGCCGTTACCTGTTCGGTGGTTGCAAAACCACCTC      SEQ ID NO: 819
 1 ---------+---------+---------+---------+---------+---------+  60
       AGGCCACCACCACCAAGGCTTACGGCAATGGACAAGCCACCAACGTTTTGGTGGAG      SEQ ID NO: 821

    G  S  G  G  G  G  S  E  C  R  Y  L  F  G  G  C  K  T  T  S   -  SEQ ID NO: 820

   CGACTGCTGCAAACACCTGGGTTGCAAATTCCGTGACAAATACTGCGCTTGGGACTTCAC
61 ---------+---------+---------+---------+---------+---------+  120
   GCTGACGACGTTTGTGGACCCAACGTTTAAGGCACTGTTTATGACGCGAACCCTGAAGTG

    D  C  C  K  H  L  G  C  K  F  R  D  K  Y  C  A  W  D  F  T   -

   CTTCTCC
121 -------
   GAAGAGGATTC

    F  S   -
```

Bacterial expression of the peptibody was as described in Example 3 and paste was stored frozen.

Refolding and purification of Fc-L-HaTx1 expressed in bacteria. Frozen, *E. coli* paste (13 g) was combined with 100 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 20 min at 4° C. The pellet was then resuspended in 200 ml 1% deoxycholic acid using a tissue grinder and then centrifuged at 22,000 g for 20 min at 4° C. The pellet was then resuspended in 200 ml water using a tissue grinder and then centrifuged at 22,000 g for 20 min at 4° C. The pellet (2.6 g) was then dissolved in 26 ml 8 M guanidine HCl, 50 mM tris HCl, pH 8.0. The dissolved pellet was then reduced by adding 30 µl 1 M dithiothreitol to 3 ml of the solution and incubating at 37° C. for 30 minutes. The reduced pellet solution was then centrifuged at 14,000 g for 5 min at room temperature, and then 2.5 ml of the supernatant was transferred to 250 ml of the refolding buffer (2 M urea, 50 mM tris, 160 mM arginine HCl, 5 mM EDTA, 1 mM cystamine HCl, 4 mM cysteine, pH 8.5) at 4° C. with vigorous stirring. The stirring rate was then slowed and the incubation was continued for 2 days at 4° C. The refolding solution was then filtered through a 0.22 µm cellulose acetate filter and stored at −70° C.

The stored refold was defrosted and then diluted with 1 L of water and the pH was adjusted to 7.5 using 1 M $H_3PO_4$. The pH adjusted material was then filtered through a 0.22 µm cellulose acetate filter and loaded on to a 10 ml Amersham SP-HP HiTrap column at 10 ml/min in S-Buffer A (20 mM $NaH_2PO_4$, pH 7.3) at 7° C. The column was then washed with several column volumes of S-Buffer A, followed by elution with a linear gradient from 0% to 60% S-Buffer B (20 mM $NaH_2PO_4$, 1 M NaCl, pH 7.3) followed by a step to 100% S-Buffer B at 5 ml/min 7° C. Fractions were then analyzed using a Coomassie brilliant blue stained tris-glycine 4-20% SDS-PAGE, and the fractions containing the desired product were pooled based on these data (15 ml). The pool was then loaded on to a 1 ml Amersham rProtein A HiTrap column in PBS at 2 ml/min 7° C. Then column was then washed with several column volumes of 20 mM $NaH_2PO_4$ pH 6.5, 1 M NaCl and eluted with 100 mM glycine pH 3.0. To the elution peak (1.4 ml), 70 µl 1 M tris HCl pH 8.5 was added, and then the pH adjusted material was filtered though a 0.22 µm cellulose acetate filter.

A spectral scan was then conducted on 20 µl of the combined pool diluted in 700 µl PBS using a Hewlett Packard 8453 spectrophotometer (FIG. 29F). The concentration of the filtered material was determined to be 1.44 mg/ml using a calculated molecular mass of 30,469 g/mol and extinction coefficient of 43,890 $M^{-1}$ $cm^{-1}$. The purity of the filtered material was then assessed using a Coomassie brilliant blue stained tris-glycine 4-20% SDS-PAGE (FIG. 29B). The endotoxin level was then determined using a Charles River Laboratories Endosafe-PTS system (0.05-5 EU/ml sensitivity) using a 33-fold dilution of the sample in Charles Rivers Endotoxin Specific Buffer BG120 yielding a result of <4 EU/mg protein. The macromolecular state of the product was then determined using size exclusion chromatography on 20 µg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 29G). The product was then subject to mass spectral analysis by diluting 1 µl of the sample into 10 µl of sinapinic acid (10 mg per ml in 0.05% trifluoroacetic acid, 50% acetonitrile). The resultant solution (1 µl) was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 29H) and these studies confirmed the integrity of the purified peptibody, within experimental error. The product was then stored at −80° C.

Example 24

Fc-L-PaTx2 Bacterial Expression

Bacterial expression of Fc-L-PaTx2. The methods to clone and express the peptibody in bacteria are described in Example 3. The vector used was pAMG21ampR-Fc-Pep and the oligos listed below were used to generate a duplex (see below) for cloning and expression in bacteria of Fc-L-PaTx2.

Oligos used to form duplex are shown below:

SEQ ID NO: 822
TGGTTCCGGTGGTGGTGGTTCCTACTGCCAGAAATGGA //;

SEQ ID NO: 823
TGTGGACCTGCGACGAAGAACGTAAATGCTGCGAAGGTCTGGTTTGCCGT
CTGTGGTGCAAACGTATCATCAACATG //;

-continued

SEQ ID NO: 824
CTTACATGTTGATGATACGTTTGCACCACAGACGGCAAA //;

SEQ ID NO: 825
CCAGACCTTCGCAGCATTTACGTTCTTCGTCGCAGGTCCACATCCATTTC
TGGCAGTAGGAACCACCACCACCGGA //;

The oligos above were used to form the duplex below:

```
1 TGGTTCCGGTGGTGGTGGTTCCTACTGCCAGAAATGGATGTGGACCTGCGACGAAGAACG      SEQ ID NO: 826
  ---------+---------+---------+---------+---------+---------+   60
      AGGCCACCACCACCAAGGATGACGGTCTTTACCTACACCTGGACGCTGCTTCTTGC      SEQ ID NO: 828

   G  S  G  G  G  G  S  Y  C  Q  K  W  M  W  T  C  D  E  E  R    - SEQ ID NO: 827

  TAAATGCTGCGAAGGTCTGGTTTGCCGTCTGTGGTGCAAACGTATCATCAACATG
61 ---------+---------+---------+---------+---------+-----
  ATTTACGACGCTTCCAGACCAAACGGCAGACACCACGTTTGCATAGTAGTTGTACATTC

   K  C  C  E  G  L  V  C  R  L  W  C  K  R  I  I  N  M   -
```

Bacterial expression of the peptibody was as described in Example 3 and paste was stored frozen.

Example 25

Fc-L-wGVIA Bacterial Expression

Bacterial expression of Fc-L-wGVIA. The methods to clone and express the peptibody in bacteria are described in Example 3. The vector used was pAMG21ampR-Fc-Pep and the oligos listed below were used to generate a duplex (see below) for cloning and expression in bacteria of Fc-L-wGVIA.

Oligos used to form duplex are shown below:

SEQ ID NO: 829
TGGTTCCGGTGGTGGTGGTTCCTGCAAATCCCCGGGTT //;

SEQ ID NO: 830
CCTCCTGCTCCCCGACCTCCTACAACTGCTGCCGTTCCTGCAACCCGTAC
ACCAAACGTTGCTACGGT;

SEQ ID NO: 831
CTTAACCGTAGCAACGTTTGGTGTACGGGTTGCAGGAA //;

SEQ ID NO: 832
CGGCAGCAGTTGTAGGAGGTCGGGGAGCAGGAGGAACCCGGGGATTTGCA
GGAACCACCACCACCGGA //;

The oligos above were used to form the duplex below:

```
  TGGTTCCGGTGGTGGTGGTTCCTGCAAATCCCCGGGTTCCTCCTGCTCCCCGACCTCCTA      SEQ ID NO: 833
1 ---------+---------+---------+---------+---------+---------+   60
      AGGCCACCACCACCAAGGACGTTTAGGGGCCCAAGGAGGACGAGGGGCTGGAGGAT      SEQ ID NO: 835

   G  S  G  G  G  G  S  C  K  S  P  G  S  S  C  S  P  T  S  Y    - SEQ ID NO: 834

  CAACTGCTGCCGTTCCTGCAACCCGTACACCAAACGTTGCTACGGT
61 ---------+---------+---------+---------+------
  GTTGACGACGGCAAGGACGTTGGGCATGTGGTTTGCAACGATGCCAATTC

   N  C  C  R  S  C  N  P  Y  T  K  R  C  Y  G
```

Bacterial expression of the peptibody was as described in Example 3 and paste was stored frozen.

Example 26

Fc-L-ωMVIIA Bacterial Expression

Bacterial expression of Fc-L-ωMVIIA. The methods to clone and express the peptibody in bacteria are described in Example 3. The vector used was pAMG21ampR-Fc-Pep and the oligos listed below were used to generate a duplex (see below) for cloning and expression in bacteria of Fc-L-ωMVIIA.

Oligos used to form duplex are shown below:

SEQ ID NO: 836
TGGTTCCGGTGGTGGTGGTTCCTGCAAAGGTAAA //;

SEQ ID NO: 837
GGTGCTAAATGCTCCCGTCTGATGTACGACTGCTGCACCGGTTCCTGCCG
TTCCGGTAAATGCGGT //;

SEQ ID NO: 836
CTTAACCGCATTTACCGGAACGGCAGGAACCGGT //;

SEQ ID NO: 839
GCAGCAGTCGTACATCAGACGGGAGCATTTAGCACCTTTACCTTTGCAGG
AACCACCACCACCGGA //;

The oligos above were used to form the duplex below:

```
   TGGTTCCGGTGGTGGTGGTTCCTGCAAAGGTAAAGGTGCTAAATGCTCCCGTCTGATGTA     SEQ ID NO: 840
 1 ---------+---------+---------+---------+---------+---------+  60
       AGGCCACCACCACCAAGGACGTTTCCATTTCCACGATTTACGAGGGCAGACTACAT     SEQ ID NO: 842

    G  S  G  G  G  G  S  C  K  G  K  G  A  K  C  S  R  L  M  Y    - SEQ ID NO: 841

   CGACTGCTGCACCGGTTCCTGCCGTTCCGGTAAATGCGGT
61 ---------+---------+---------+---------+
   GCTGACGACGTGGCCAAGGACGGCAAGGCCATTTACGCCAATTC

    D  C  C  T  G  S  C  R  S  G  K  C  G   -
```

Bacterial expression of the peptibody was as described in Example 3 and paste was stored frozen.

Example 27

Fc-L-Ptu1 Bacterial Expression

Bacterial expression of Fc-L-Ptu1. The methods to clone and express the peptibody in bacteria are described in Example 3. The vector used was pAMG21ampR-Fc-Pep and the oligos listed below were used to generate a duplex (see below) for cloning and expression in bacteria of Fc-L-Ptu1.

Oligos used to form duplex are shown below:

```
                                           SEQ ID NO: 843
TGGTTCCGGTGGTGGTGGTTCCGCTGAAAAAGACTGCATC //;

                                           SEQ ID NO: 844
GCTCCGGGTGCTCCGTGCTTCGGTACCGACAAACCGTGCTGCAACCCGCG
TGCTTGGTGCTCCTCCTACGCTAACAAATGCCTG //;

                                           SEQ ID NO: 845
CTTACAGGCATTTGTTAGCGTAGGAGGAGCACCAAGCACG //;

                                           SEQ ID NO: 846
CGGGTTGCAGCACGGTTTGTCGGTACCGAAGCACGGAGCACCCGGAGCGA
TGCAGTCTTTTTCAGCGGAACCACCACCACCGGA //;
```

The oligos above were used to form the duplex below:

```
  1 TGGTTCCGGTGGTGGTGGTTCCGCTGAAAAAGACTGCATCGCTCCGGGTGCTCCGTGCTT   SEQ
                                                                    ID
                                                                    NO:
                                                                    847
    ---------+---------+---------+---------+---------+---------+   60
        AGGCCACCACCACCAAGGCGACTTTTTCTGACGTAGCGAGGCCCACGAGGCACGAA   SEQ
                                                                    ID
                                                                    NO:
                                                                    849

     G  S  G  G  G  G  S  A  E  K  D  C  I  A  P  G  A  P  C  F    -  SEQ ID NO: 848

    CGGTACCGACAAACCGTGCTGCAACCCGCGTGCTTGGTGCTCCTCCTACGCTAACAAATG
 61 ---------+---------+---------+---------+---------+---------+   120
    GCCATGGCTGTTTGGCACGACGTTGGGCGCACGAACCACGAGGAGGATGCGATTGTTTAC

     G  T  D  K  P  C  C  N  P  R  A  W  C  S  S  Y  A  N  K  C    -

    CCTG
121 ----
    GGACATTC

     L  -
```

Bacterial expression of the peptibody was as described in Example 3 and paste was stored frozen.

Example 28

Fc-L-ProTx1 Bacterial Expression

Bacterial expression of Fc-L-ProTx1. The methods to clone and express the peptibody in bacteria are described in Example 3. The vector used was pAMG21ampR-Fc-Pep and the oligos listed below were used to generate a duplex (see below) for cloning and expression in bacteria of Fc-L-ProTx1.

Oligos used to form duplex are shown below:

```
                                           SEQ ID NO: 850
TGGTTCCGGTGGTGGTGGTTCCGAATGCCGTTACTGGCTGG //;

                                           SEQ ID NO: 851
GTGGTTGCTCCGCTGGTCAGACCTGCTGCAAACACCTGGTTTGCTCCCGT
CGTCACGGTTGGTGCGTTTGGGACGGTACCTTCTCC //;

                                           SEQ ID NO: 852
CTTAGGAGAAGGTACCGTCCCAAACGCACCAACCGTGACGA //;

                                           SEQ ID NO: 853
CGGGAGCAAACCAGGTGTTTGCAGCAGGTCTGACCAGCGGAGCAACCACC
CAGCCAGTAACGGCATTCGGAACCACCACCACCGGA //;
```

The oligos above were used to form the duplex below:

```
  1 TGGTTCCGGTGGTGGTGGTTCCGAATGCCGTTACTGGCTGGGTGGTTGCTCCGCTGGTCA      SEQ ID HO: 854
    ---------+---------+---------+---------+---------+---------+   60
        AGGCCACCACCACCAAGGCTTACGGCAATGACCGACCCACCAACGAGGCGACCAGT      SEQ ID NO: 856

     G  S  G  G  G  G  S  E  C  R  Y  W  L  G  G  C  S  A  G  Q    -  SEQ ID NO: 855

    GACCTGCTGCAAACACCTGGTTTGCTCCCGTCGTCACGGTTGGTGCGTTTGGGACGGTAC
 61 ---------+---------+---------+---------+---------+---------+   120
    CTGGACGACGTTTGTGGACCAAACGAGGGCAGCAGTGCCAACCACGCAAACCCTGCCATG

     T  C  C  K  H  L  V  C  S  R  R  H  G  W  C  V  W  D  G  T    -

    CTTCTCC
121 -------
    GAAGAGGATTC

     F  S   -
```

Bacterial expression of the peptibody was as described in Example 3 and paste was stored frozen.

Example 29

Fc-L-BeKM1 Bacterial Expression

Bacterial expression of Fc-L-BeKM1. The methods to clone and express the peptibody in bacteria are described in Example 3. The vector used was pAMG21ampR-Fc-Pep and the oligos listed below were used to generate a duplex (see below) for cloning and expression in bacteria of Fc-L-BeKM1.

Oligos used to form duplex are shown below:

```
                                            SEQ ID NO: 857
TGGTTCCGGTGGTGGTGGTTCCCGTCCGACCGACATCAAATG //;

                                            SEQ ID NO: 858
CTCCGAATCCTACCAGTGCTTCCCGGTTTGCATCCCGTTTCGGTAAAACC
AACGGTCGTTGCGTTAACGGTTTCTGCGACTGCTTC //;

                                            SEQ ID NO: 859
CTTAGAAGCAGTCGCAGAAACCGTTAACGCAACGACCGTTGG //;

                                            SEQ ID NO: 860
TTTTACCGAAACGGGATTTGCAAACCGGGAAGCACTGGTAGGATTCGGAG
CATTTGATGTCGGTCGGACGGGAACCACCACCACCGGA //;
```

The oligos above were used to form the duplex below:

```
    TGGTTCCGGTGGTGGTGGTTCCCGTCCGACCGACATCAAATGCTCCGAATCCTACCAGTG      SEQ ID NO: 861
  1 ---------+---------+---------+---------+---------+---------+   60
        AGGCCACCACCACCAAGGGCAGGCTGGCTGTAGTTTACGAGGCTTAGGATGGTCAC      SEQ ID NO: 863

     G  S  G  G  G  G  S  R  P  T  D  I  K  C  S  E  S  Y  Q  C    -  SEQ ID NO: 862

    CTTCCCGGTTTGCAAATCCCGTTTCGGTAAAACCAACGGTCGTTGCGTTAACGGTTTCTG
 61 ---------+---------+---------+---------+---------+---------+   120
    GAAGGGCCAAACGTTTAGGGCAAAGCCATTTTGGTTGCCAGCAACGCAATTGCCAAAGAC

     F  P  V  C  K  S  R  F  G  K  T  N  G  R  C  V  N  G  F  C    -

    CGACTGCTTC
121 ---------+
    GCTGACGAAGATTC

     D  C  F   -
```

Bacterial expression of the peptibody was as described in Example 3 and paste was stored frozen.

Example 30

Fc-L-CTX Bacterial Expression

Bacterial expression of Fc-L-CTX. The methods to clone and express the peptibody in bacteria are described in Example 3. The vector used was pAMG21ampR-Fc-Pep and the oligos listed below were used to generate a duplex (see below) for cloning and expression in bacteria of Fc-L-CTX.

Oligos used to form duplex are shown below:

```
                                            SEQ ID NO: 864
TGGTTCCGGTGGTGGTGGTTCCATGTGCATGCCGTGCTTCAC //;

                                            SEQ ID NO: 865
CACCGACCACCAGATGGCTCGTAAATGCGACGACTGCTGCGGTGGTAAAG
GTCGTGGTAAATGCTACGGTCCGCAGTGCCTGTGCCGT //;

                                            SEQ ID NO: 866
CTTAACGGCACAGGCACTGCGGACCGTAGCATTTACCACGAC //;

                                            SEQ ID NO: 867
CTTTACCACCGCAGCAGTCGTCGCATTTACGAGCCATCTGGTGGTCGGTG
GTGAAGCACGGCATGCACATGGAACCACCACCACCGGA //;
```

The oligos above were used to form the duplex below:

```
     TGGTTCCGGTGGTGGTGGTTCCATGTGCATGCCGTGCTTCACCACCGACCACCAGATGGC      SEQ ID NO: 868
   1 ---------+---------+---------+---------+---------+---------+  60
         AGGCCACCACCACCAAGGTACACGTACGGCACGAAGTGGTGGCTGGTGGTCTACCG      SEQ ID NO: 870

      G  S  G  G  G  G  S  M  C  M  P  C  F  T  T  D  H  Q  M  A    - SEQ ID NO: 869

     TCGTAAATGCGACGACTGCTGCGGTGGTAAAGGTCGTGGTAAATGCTACGGTCCGCAGTG
  61 ---------+---------+---------+---------+---------+---------+  120
     AGCATTTACGCTGCTGACGACGCCACCATTTCCAGCACCATTTACGATGCCAGGCGTCAC

      R  K  C  D  D  C  C  G  G  K  G  R  G  K  C  Y  G  P  Q  C    -

     CCTGTGCCGT
 121 ---------+
     GGACACGGCACCAC

      L  C  R  -
```

Bacterial expression of the peptibody was as described in Example 3 and paste was stored frozen.

Example 31

N-Terminally PEGylated-Des-Arg1-ShK

Peptide Synthesis of reduced Des-Arg1-ShK. Des-Arg1-ShK, having the sequence

SCIDTIPKSRCTAFQCKHSMKYRL-SFCRKTCGTC (Peptide 1, SEQ ID NO: 92)

was synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-(9-fluorenylmethyloxy-carbonyl)- and side-chain protected amino acids were purchased from Midwest Biotech Incorporated. Fmoc-Cys(Trt)-Tentagel™ resin was purchased from Fluka. The following side-chain protection strategy was employed: Asp(O$^t$Bu), Arg(Pbf), Cys(Trt), Gln(Trt), His(Trt), Lys(N$^\epsilon$-Boc), Ser (O$^t$Bu), Thr(O$^t$Bu) and Tyr(O$^t$Bu). Two Oxazolidine dipeptides, Fmoc-Gly-Thr($^{\psi Me,Me}$Pro)-OH and Fmoc-Leu-Ser ($^{\psi Me,Me}$Pro)-OH, were used in the chain assembly and were obtained from NovaBiochem and used in the synthesis of the sequence. The protected amino acid derivatives (20 mmol) were dissolved in 100 ml 20% dimethyl sulfoxide (DMSO) in DMF (v/v). Protected amino acids were activated with 20 mM HBTU, 400 mM NMM in 20% DMSO in DMF, and coupling were carried out using two treatments with 0.5 mmol protected amino acid, 0.5 mmol HBTU, 1 mmol NMM in 20% DMF/DMSO for 25 minutes and then 40 minutes. Fmoc deprotection reactions were carried out with two treatments using a 20% piperidine in DMF (v/v) solution for 10 minutes and then 15 minutes. Following synthesis, the resin was then drained, and washed with DCM, DMF, DCM, and then dried in vacuo. The peptide-resin was deprotected and released from the resin by treatment with a TFA/EDT/TIS/$H_2O$ (92.5:2.5:2.5:2.5 (v/v)) solution at room temperature for 1 hour. The volatiles were then removed with a stream of nitrogen gas, the crude peptide precipitated twice with cold diethyl ether and collected by centrifugation. The crude peptide was then analyzed on a Waters 2795 analytical RP-HPLC system using a linear gradient (0-60% buffer B in 12 minutes, A: 0.1% TFA in water, B: 0.1% TFA in acetonitrile) on a Jupiter 4 μm Proteo™ 90 Å column. A PE-Sciex™ API Electro-spray mass spectrometer was used to confirm correct peptide product mass. Crude peptide was obtained in 143 mg yield at approximately 70% pure based as estimated by analytical RP-HPLC analysis. Reduced Des-Arg1-ShK (Peptide 1) Retention time (Rt)=5.31 minutes, calculated molecular weight=3904.6917 Da (average); Experimental observed molecular weight 3907.0 Da.

Figure 20A:
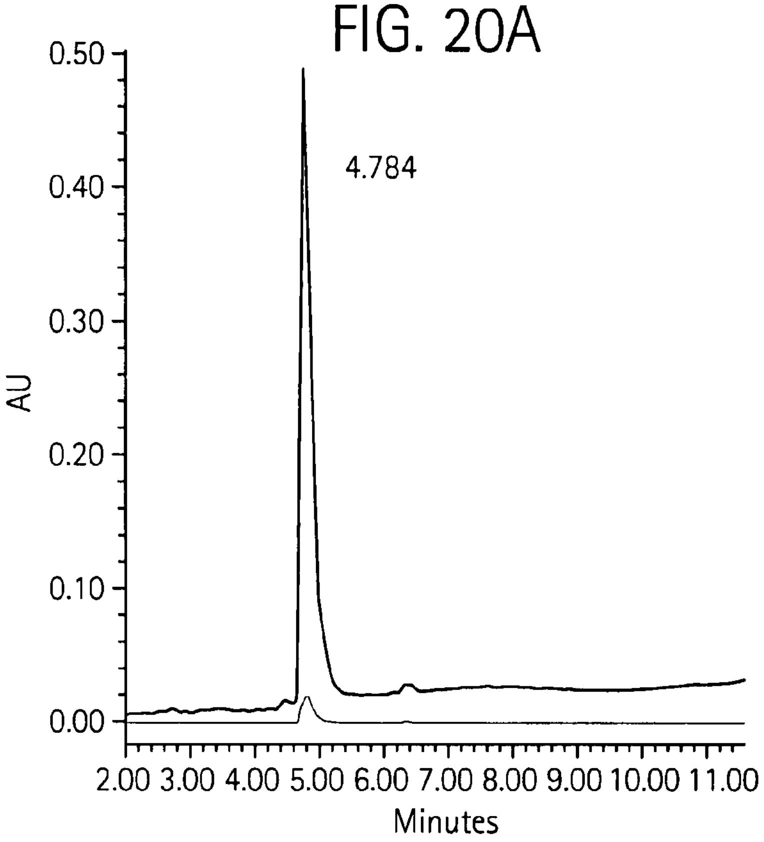
FIG. 20A shows a reversed-phase HPLC analysis at 214 nm and FIG. 20B shows electrospray mass analysis of folded ShK[2-35], also described as folded-"Des-Arg1-ShK" (Peptide 2).
Figure 20B:
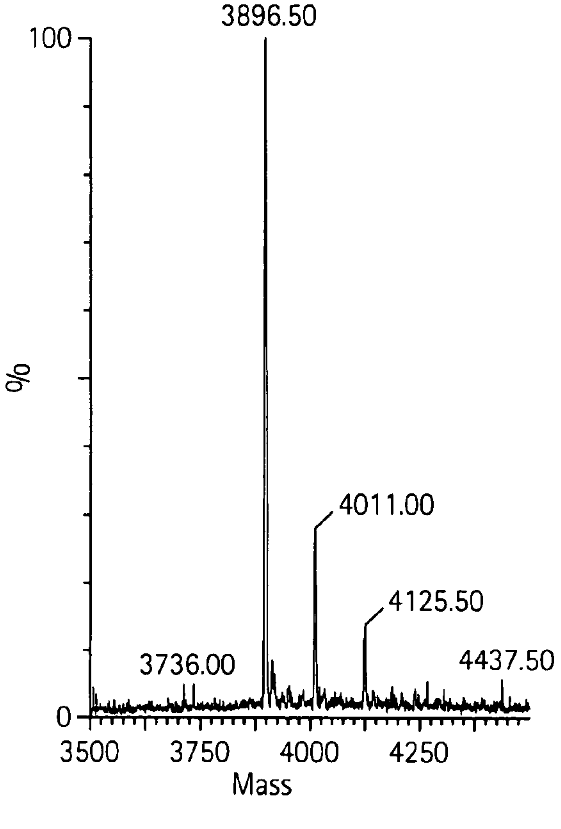
Figure 21:
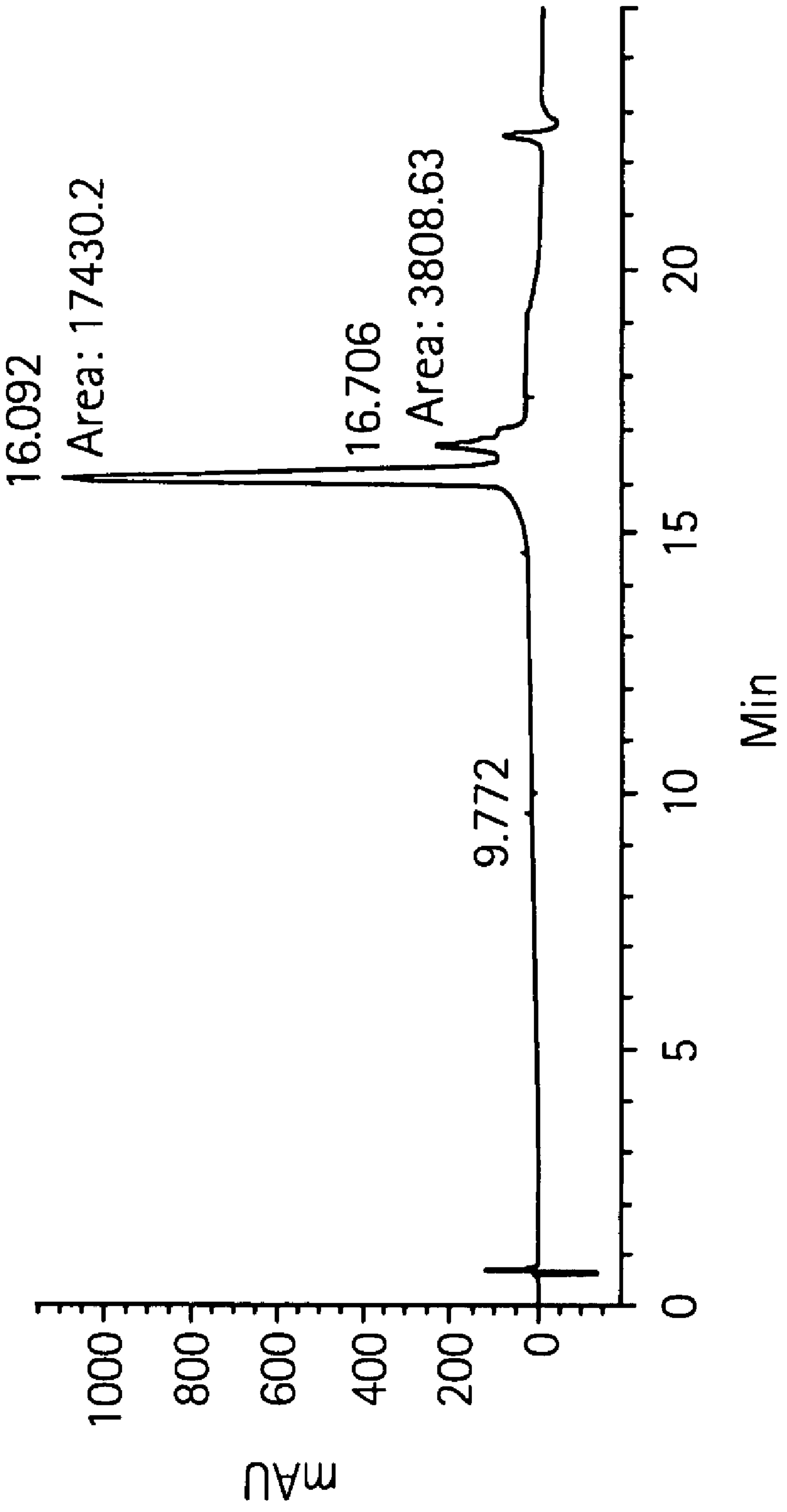
FIG. 21 shows reversed phase HPLC analysis at 214 nm of N-terminally PEGylated ShK[2-35], also referred to as N-Terminally PEGylated-"Des-Arg1-ShK".
Figure 22B:
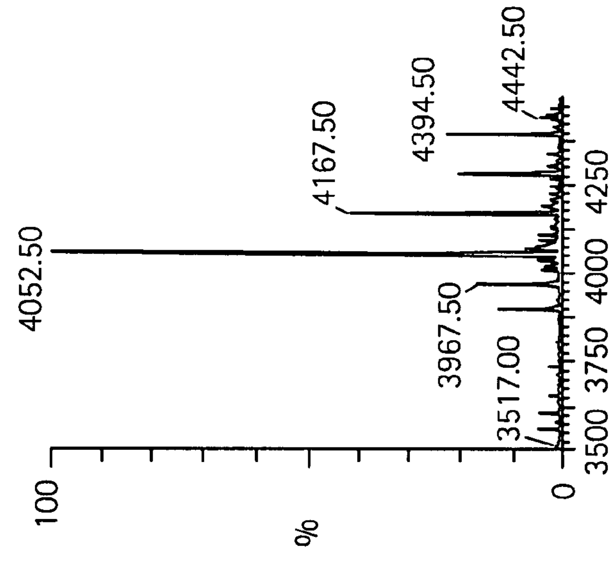
FIG. 22B shows electrospray mass analysis of folded ShK [1-35], also referred to as "ShK".
Figure 22A:
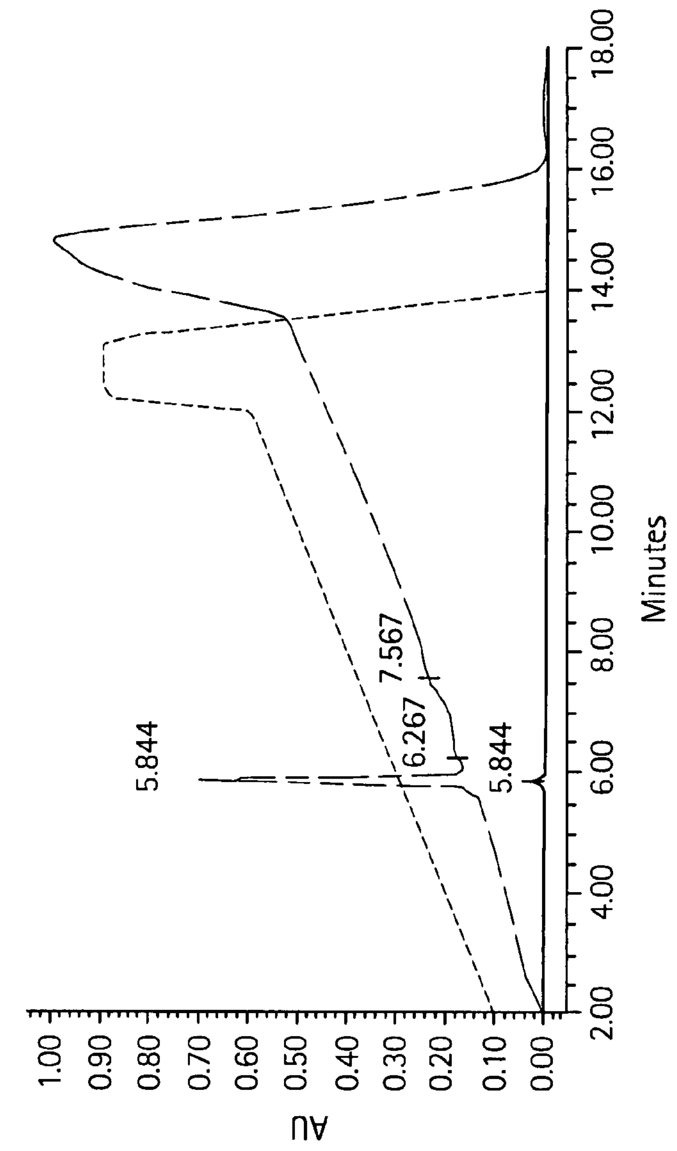
FIG. 22A shows a reversed-phase HPLC analysis at 214 nm of folded ShK[1-35], also referred to as "ShK".

Folding of Des-Arq1-ShK (Disulphide bond formation). Following TFA cleavage and peptide precipitation, reduced Des-Arg1-ShK was then air-oxidized to give the folded peptide. The crude cleaved peptide was extracted using 20% AcOH in water (v/v) and then diluted with water to a concentration of approximately 0.15 mg reduced Des-Arg1-ShK per mL, the pH adjusted to about 8.0 using $NH_4OH$ (28-30%), and gently stirred at room temperature for 36 hours. Folding process was monitored by LC-MS analysis. Following this, folded Des-Arg1-ShK peptide was purified using reversed phase HPLC using a 1 Luna 5 μm C18 100 Å Proteo™ column with a linear gradient 0-40% buffer B in 120 min (A=0.1% TFA in water, B=0.1% TFA in acetonitrile). Folded Des-Arg1-ShK crude peptide eluted earlier (when compared to the elution time in its reduced form) at approximately 25% buffer B. Folded Des-Arg1-ShK (Peptide 2) was obtained in 23.2 mg yield in >97% purity as estimated by analytical RP-HPLC analysis (FIG. 20A). Calculated molecular weight=3895.7693 Da (monoisotopic), experimental observed molecular weight=3896.5 Da (analyzed on a Waters LCT Premier Micromass MS Technologies). (FIG. 20B). Des-Arg1-ShK disulfide connectivity was C1-C6, C2-C4, C3-C5.

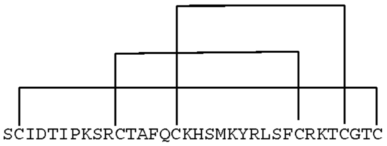

(Peptide 2, SEQ ID NO: 58)

Figure 23:
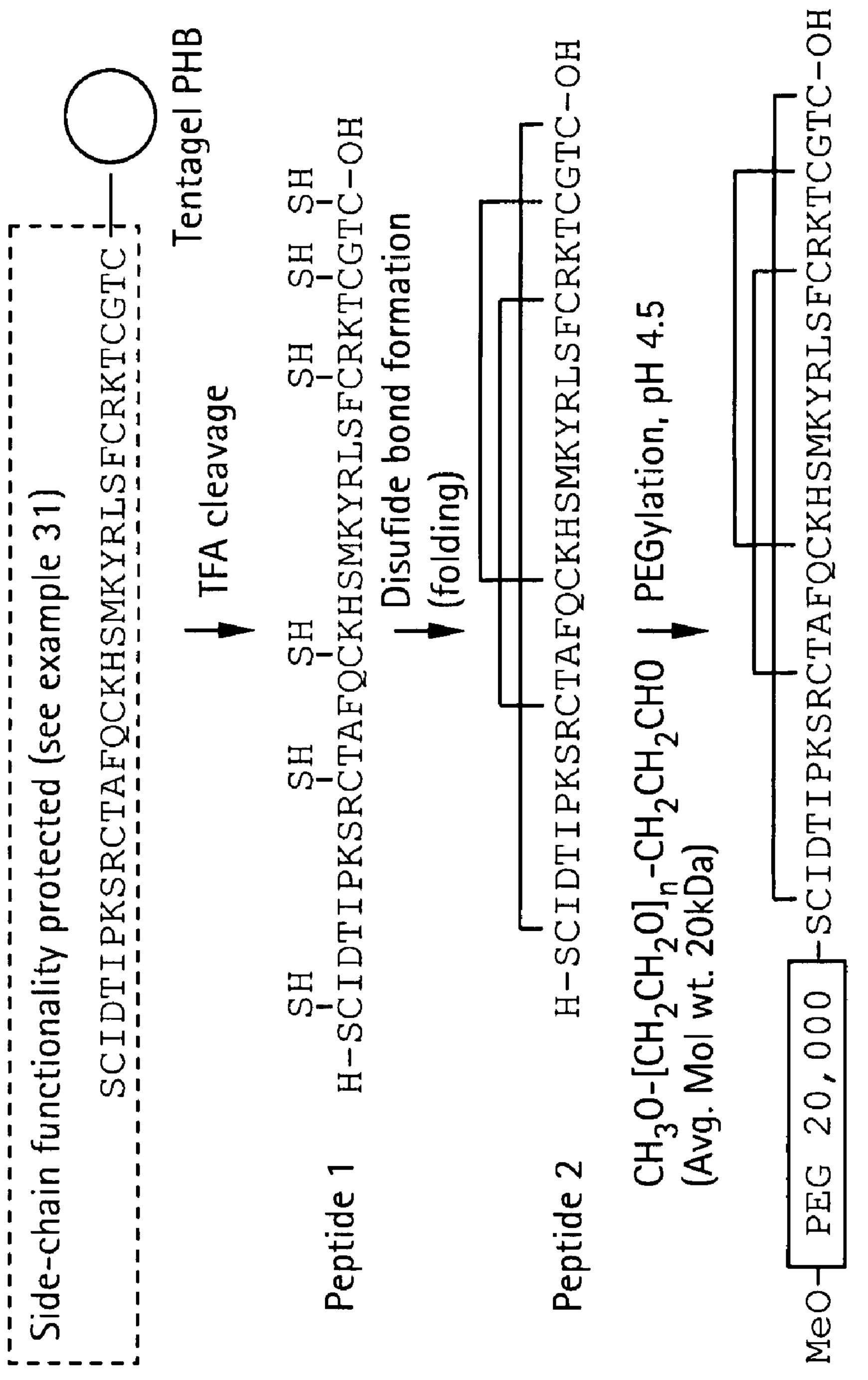
FIG. 23 illustrates a scheme for N-terminal PEGylation of ShK[2-35] (SEQ ID NO: 92 and SEQ ID NO: 58, also referred to as "Des-Arg1-ShK" or "ShK d1") by reductive amination, which is also described in Example 31 hereinafter.

N-terminal PEGylation of Folded Des-Arq1-ShK. Folded Des-Arg1-ShK, (Peptide 2) was dissolved in water at 1 mg/ml concentration. A 2 M MeO-PEG-Aldehyde, $CH_3O$—$[CH_2CH_2O]n$-$CH_2CH_2CHO$ (average molecular weight 20 kDa), solution in 50 mM NaOAc, pH 4.5, and a separate 1 M solution of $NaCNBH_3$ were freshly prepared. The peptide solution was then added to the MeO-PEG-Aldehyde containing solution and was followed by the addition of the $NaCNBH_3$ solution. The reaction stoichiometry was peptide: PEG:NaCNBH3 (1:2:0.02), respectively. The reaction was left for 48 hours, and was analyzed on an Agilent 1100 RP-HPLC system using Zorbax™ 300SB-C8 5 μm column at 40° C. with a linear gradient (6-60% B in 16 minutes, A: 0.1% TFA in water, B: 0.1% TFA/90% ACN in water). Mono-pegylated folded Des-Arg1-ShK constituted approximately 58% of the crude product by analytical RP-HPLC. Mono Pegylated Des-Arg1-ShK was then isolated using a HiTrap™ 5 ml SP HP cation exchange column on AKTA FPLC system at 4° C. at 1 mL/min using a gradient of 0-50% B in 25 column volumes (Buffers: A=20 mM sodium acetate pH 4.0, B=1 M NaCl, 20 mM sodium acetate, pH 4.0). The fractions were analyzed using a 4-20 tris-Gly SDS-PAGE gel and RP-HPLC (as described for the crude). SDS-PAGE gels were run for 1.5 hours at 125 V, 35 mA, 5 W. Pooled product was then dialyzed at 4° C. in 3 changes of 1 L of A4S buffer (10 mM NaOAc, 5% sorbitol, pH 4.0). The dialyzed product was then concentrated in 10 K microcentrifuge filter to 2 mL volume and sterile-filtered using 0.2 μM syringe filter to give the final product. N-Terminally PEGylated-Des-Arg1-ShK (Peptide 3) was isolated in 1.7 mg yield with 85% purity as estimated by analytical RP-HPLC analysis (FIG. 23).

The N-Terminally PEGylated-Des-Arg1-ShK, also referred to as "PEG-ShK[2-35]", was active in blocking human Kv1.3 (FIG. 38A and FIG. 38B) as determined by patch clamp electrophysiology (Example 36).

Example 32

N-Terminally PEGylated ShK

Figure 17:
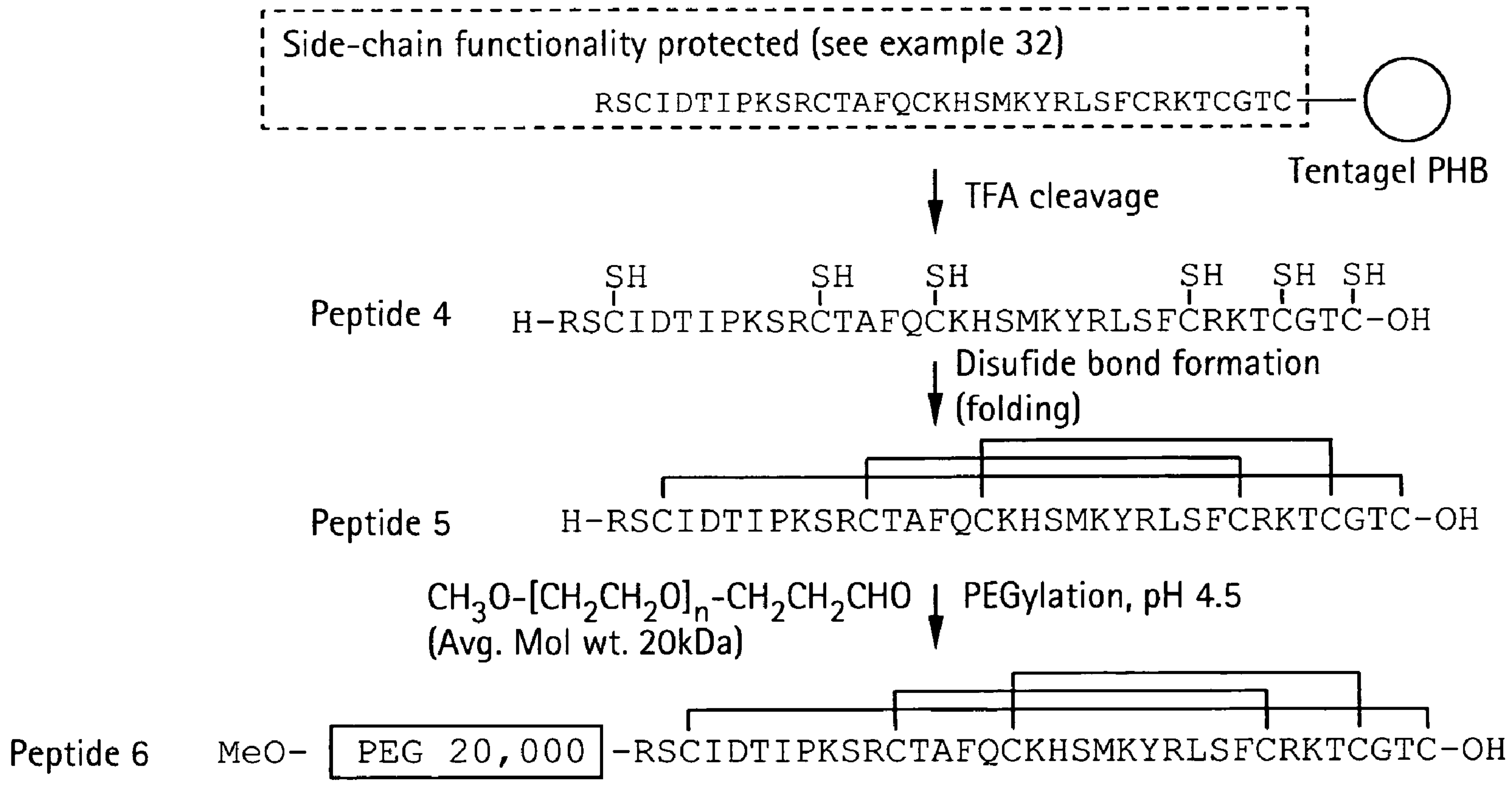
FIG. 17 shows a scheme for N-terminal PEGylation of ShK peptide (SEQ ID NO: 5 and SEQ ID NO:10) by reductive amination, which is also described in Example 32 hereinafter.

The experimental procedures of this working example correspond to the results shown in FIG. 17.

Peptide Synthesis of reduced ShK. ShK, having the amino acid sequence

RSCIDTIPKSRCTAFQCKHSMKYRLS-
FCRKTCGTC (Peptide 4, SEQ ID NO:5)

was synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-9-fluorenylmethyloxycarbonyl) and side-chain protected amino acids were purchased from Midwest Biotech Incorporated. Fmoc-Cys(Trt)-Tentagel™ resin was purchased from Fluka. The following side-chain protection strategy was employed: Asp($O^tBu$), Arg(Pbf), Cys(Trt), Gln(Trt), His(Trt), Lys($N^\epsilon$-Boc), Ser ($O^tBu$), Thr($O^tBu$) and Tyr($O^tBu$). Two Oxazolidine dipeptides, Fmoc-Gly-Thr($^{\psi Me,Me}$Pro)-OH and Fmoc-Leu-Ser ($^{\psi Me,Me}$Pro)-OH, were used in the chain assembly and were obtained from NovaBiochem and used in the synthesis of the sequence. The protected amino acid derivatives (20 mmol) were dissolved in 100 ml 20% dimethyl sulfoxide (DMSO) in DMF (v/v). Protected amino acids were activated with 200 mM HBTU, 400 mM NMM in 20% DMSO in DMF, and coupling were carried out using two treatments with 0.5 mmol protected amino acid, 0.5 mmol HBTU, 1 mmol NMM in 20% DMF/DMSO for 25 minutes and then 40 minutes. Fmoc deprotections were carried out with two treatments using a 20% piperidine in DMF (v/v) solution for 10 minutes and then 15 minutes. Following synthesis, the resin was then drained, and washed with DCM, DMF, DCM, and then dried in vacuo. The peptide-resin was deprotected and released from the resin by treatment with a TFA/EDT/TIS/$H_2O$ (92.5:2.5:2.5:2.5 (v/v)) solution at room temperature for 1 hour. The volatiles were then removed with a stream of nitrogen gas, the crude peptide precipitated twice with cold diethyl ether and collected by centrifugation. The crude peptide was then analyzed on a Waters 2795 analytical RP-HPLC system using a linear gradient (0-60% buffer B in 12 minutes, A: 0.1% TFA in water, B: 0.1% TFA in acetonitrile) on a Jupiter 4 μm Proteo™ 90 Å column. A PE-Sciex API Electro-spray mass spectrometer was used to confirm correct peptide product mass. Crude peptide was approximately was obtained 170 mg yield at about 45% purity as estimated by analytical RP-HPLC analysis. Reduced ShK (Peptide 4) Retention time (Rt)=5.054 minutes, calculated molecular weight=4060.8793 Da (average); experimental observed molecular weight=4063.0 Da.

Folding of ShK (Disulphide bond formation). Following TFA cleavage and peptide precipitation, reduced ShK was then air oxidized to give the folded peptide. The crude cleaved peptide was extracted using 20% AcOH in water (v/v) and then diluted with water to a concentration of approximately 0.15 mg reduced ShK per mL, the pH adjusted to about 8.0 using $NH_4OH$ (28-30%), and gently stirred at room temperature for 36 hours. Folding process was monitored by LC-MS analysis. Following this, folded ShK peptide was purified by reversed phase HPLC using a 1" Luna 5 μm C18 100 Å Proteo™ column with a linear gradient 0-40% buffer B in 120 min (A=0.1% TFA in water, B=0.1% TFA in acetonitrile). Folded ShK crude peptide eluted earlier (when compared to the elution time in its reduced form) at approximately 25% buffer B. Folded ShK (Peptide 5) was obtained in 25.5 mg yield in >97% purity as estimated by analytical RP-HPLC analysis. See FIG. 60. Calculated molecular weight=4051.8764 Da (monoisotopic); experimental observed molecular weight=4052.5 Da (analyzed on Waters LCT Premier Micromass MS Technologies). ShK disulfide connectivity was C1-C6, C2-C4, and C3-C5.

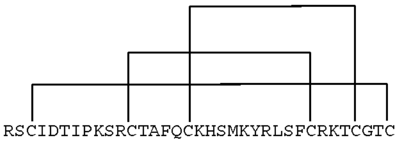

RSCIDTIPKSRCTAFQCKHSMKYRLSFCRKTCGTC
(Peptide 5, SEQ ID NO: 10)

N-terminal PEGylation of Folded ShK. Folded ShK, having the amino acid sequence

RSCIDTIPKSRCTAFQCKHSMKYRLSFCRKTCGTC (SEQ ID NO: 5)

can be dissolved in water at 1 mg/ml concentration. A 2 M MeO-PEG-Aldehyde, $CH_3O—CH_2CH_2O]n-CH_2CH_2CHO$ (average molecular weight 20 kDa), solution in 50 mM NaOAc, pH 4.5 and a separate 1 M solution of $NaCNBH_3$ can be freshly prepared. The peptide solution can be then added to the MeO-PEG-Aldehyde containing solution and can be followed by the addition of the $NaCNBH_3$ solution. The reaction stoichiometry can be peptide:PEG:NaCNBH3 (1:2:0.02), respectively. The reaction can be left for 48 hours, and can be analyzed on an Agilent™ 1100 RP-HPLC system using Zorbax™ 300SB-C8 5 μm column at 40° C. with a linear gradient (6-60% B in 16 minutes, A: 0.1% TFA in water, B: 0.1% TFA/90% ACN in water). Mono-pegylated Shk (Peptide 6)

can be then isolated using a HiTrap™ 5 mL SP HP cation exchange column on AKTA FPLC system at 4° C. at 1 mL/min using a gradient of 0-50% B in 25 column volumes (Buffers: A=20 mM sodium acetate pH 4.0, B=1 M NaCl, 20 mM sodium acetate, pH 4.0). The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM sodium acetate, 5% sorbitol, pH 4.0). The dialyzed product can be then concentrated in 10 K microcentrifuge filter to 2 mL volume and sterile-filtered using 0.2 μM syringe filter to give the final product.

Example 33

N-Terminally PEGylated ShK by Oxime Formation

Peptide Synthesis of reduced ShK. ShK, having the sequence

RSCIDTIPKSRCTAFQCKHSMKYRLSFCRKTCGTC (SEQ ID NO: 5)

can be synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Tentagel™-S PHB Fmoc-Cys(Trt)-resin. N-alpha-(9-fluorenylmethyloxy-carbonyl)- and side-chain protected amino acids can be purchased from Midwest Biotech Incorporated. Fmoc-Cys(Trt)-Tentagel™ resin can be purchased from Fluka. The following side-chain protection strategy can be employed: Asp($O^tBu$), Arg(Pbf), Cys(Trt), Gln(Trt), His(Trt), Lys($N^\epsilon$-Boc), Ser ($O^tBu$), Thr($O^tBu$) and Tyr($O^tBu$). Two Oxazolidine dipeptides, Fmoc-Gly-Thr($\Psi^{Me,Me}$Pro)-OH and Fmoc-Leu-Ser ($\psi^{Me,Me}$Pro)-OH, can be used in the chain assembly and can be obtained from NovaBiochem and used in the synthesis of the sequence. The protected amino acid derivatives (20 mmol) can be dissolved in 100 ml 20% dimethyl sulfoxide (DMSO) in DMF (v/v). Protected amino acids can be activated with 200 mM HBTU, 400 mM NMM in 20% DMSO in DMF, and coupling can be carried out using two treatments with 0.5 mmol protected amino acid, 0.5 mmol HBTU, 1 mmol NMM in 20% DMF/DMSO for 25 minutes and then 40 minutes. Fmoc deprotection reactions can be carried out with two treatments using a 20% piperidine in DMF (v/v) solution for 10 minutes and then 15 minutes. Following the chain-assembly of the Shk peptide, Boc-amionooxyacetic acid (1.2 equiv) can be coupled at the N-terminus using 0.5 M HBTU in DMF with 4 equiv collidine for 5 minutes. Following synthesis, the resin can be then drained, and washed with DCM, DMF, DCM, and then dried in vacuo. The peptide-resin can be deprotected and released from the resin by treatment with a TFA/amionooxyacetic acid/TIS/EDT/H2O (90: 2.5:2.5:2.5:2.5) solution at room temperature for 1 hour. The volatiles can be then removed with a stream of nitrogen gas, the crude peptide precipitated twice with cold diethyl ether and collected by centrifugation. The aminooxy-Shk peptide (Peptide 7) can be then analyzed on a Waters 2795 analytical RP-HPLC system using a linear gradient (0-60% buffer B in 12 minutes, A: 0.1% TFA in water also containing 0.1% aminooxyacetic acid, B: 0.1% TFA in acetonitrile) on a Jupiter 4 μm Proteo™ 90 Å column.

Reversed-Phase HPLC Purification. Preparative Reversed-phase high-performance liquid chromatography can be performed on C18, 5 μm, 2.2 cm×25 cm) column. Chromatographic separations can be achieved using linear gradients of buffer B in A (A=0.1% aqueous TFA; B=90% aq. ACN containing 0.09% TFA and 0.1% aminooxyacetic acid), typically 5-95% over 90 minutes at 15 mL/min. Preparative HPLC fractions can be characterized by ESMS and photodiode array (PDA) HPLC, combined and lyophilized.

N-Terminal PEGylation of Shk by Oxime Formation. Lyophilized aminooxy-Shk (Peptide 7) can be dissolved in 50% HPLC buffer A/B (5 mg/mL) and added to a two-fold molar excess of MeO-PEG-Aldehyde, $CH_3O—[CH_2CH_2O]_n—CH_2CH_2CHO$ (average molecular weight 20 kDa). The reaction can be left for 24 hours, and can be analyzed on an Agilent™ 1100 RP-HPLC system using Zorbax™ 300SB-C8 5 μm column at 40° C. with a linear gradient (6-60% B in 16 minutes, A: 0.1% TFA in water, B: 0.1% TFA/90% ACN in water). Mono-pegylated reduced Shk constituted approximately 58% of the crude product by analytical RP-HPLC. Mono PEGylated (oximated) Shk (Peptide 8) can be then isolated using a HiTrap™ 5 mL SP HP cation exchange column on AKTA FPLC system at 4° C. at 1 mL/min using a gradient of 0-50% B in 25 column volumes (Buffers: A 20 mM sodium acetate pH 4.0, B=1 M NaCl, 20 mM sodium acetate, pH 4.0). The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM NaOAc, 5% sorbitol, pH 4.0). The dialyzed product can be then concentrated in 10 K microcentrifuge filter to 2 mL volume and sterile-filtered using 0.2 μM syringe filter to give the final product.

Folding of ShK (Disulphide bond formation). The mono-PEGylated (oximated) Shk can be dissolved in 20% AcOH in water (v/v) and can be then diluted with water to a concentration of approximately 0.15 mg peptide mL, the pH adjusted to about 8.0 using $NH_4OH$ (28-30%), and gently stirred at room temperature for 36 hours. Folding process can be monitored by LC-MS analysis. Following this, folded mono-PEGylated (oximated) Shk (Peptide 9) can be purified using by reversed phase HPLC using a 1' Luna 5 μm C18 100 Å Proteo™ column with a linear gradient 0-40% buffer B in 120 min (A=0.1% TFA in water, B=0.1% TFA in acetonitrile). Mono-PEGylated (oximated) ShK disulfide connectivity can be C1-C6, C2-C4, and C3-C5.

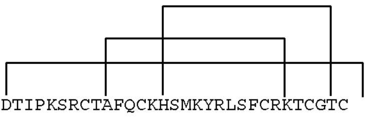

$MeO-PEG-CH_2CH_2CH_2NHOCH_2CO$-RSCIDTIPKSRCTAFQCKHSMKYRLSFCRKTCGTC (Peptide 9, SEQ ID NO: 10)

Example 34

N-Terminally PEGylated ShK (Amidation)

Figure 18:
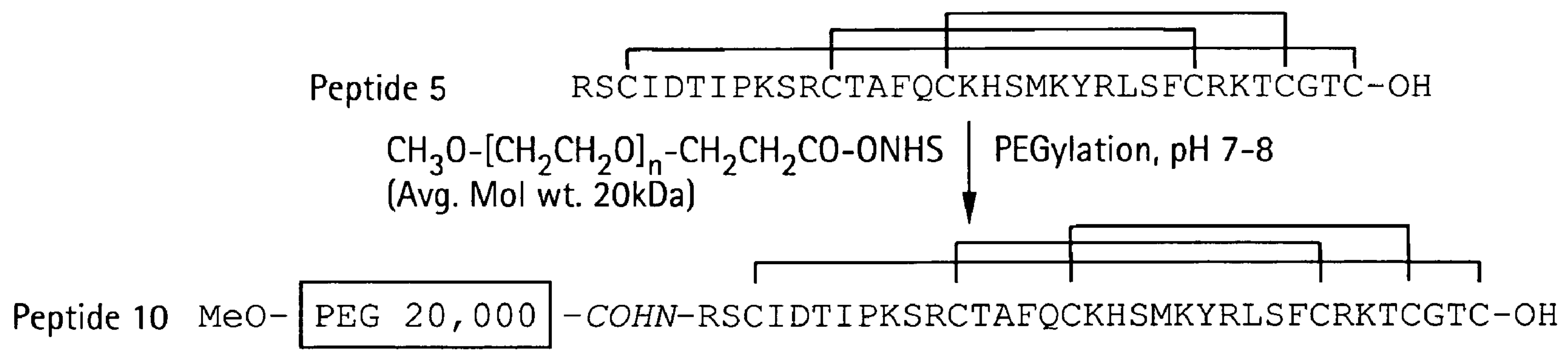
FIG. 18 shows a scheme for N-terminal PEGylation of ShK peptide (SEQ ID NO: 5 and SEQ ID NO:10) via amide formation, which is also described in Example 34 hereinafter.
Figure 19:
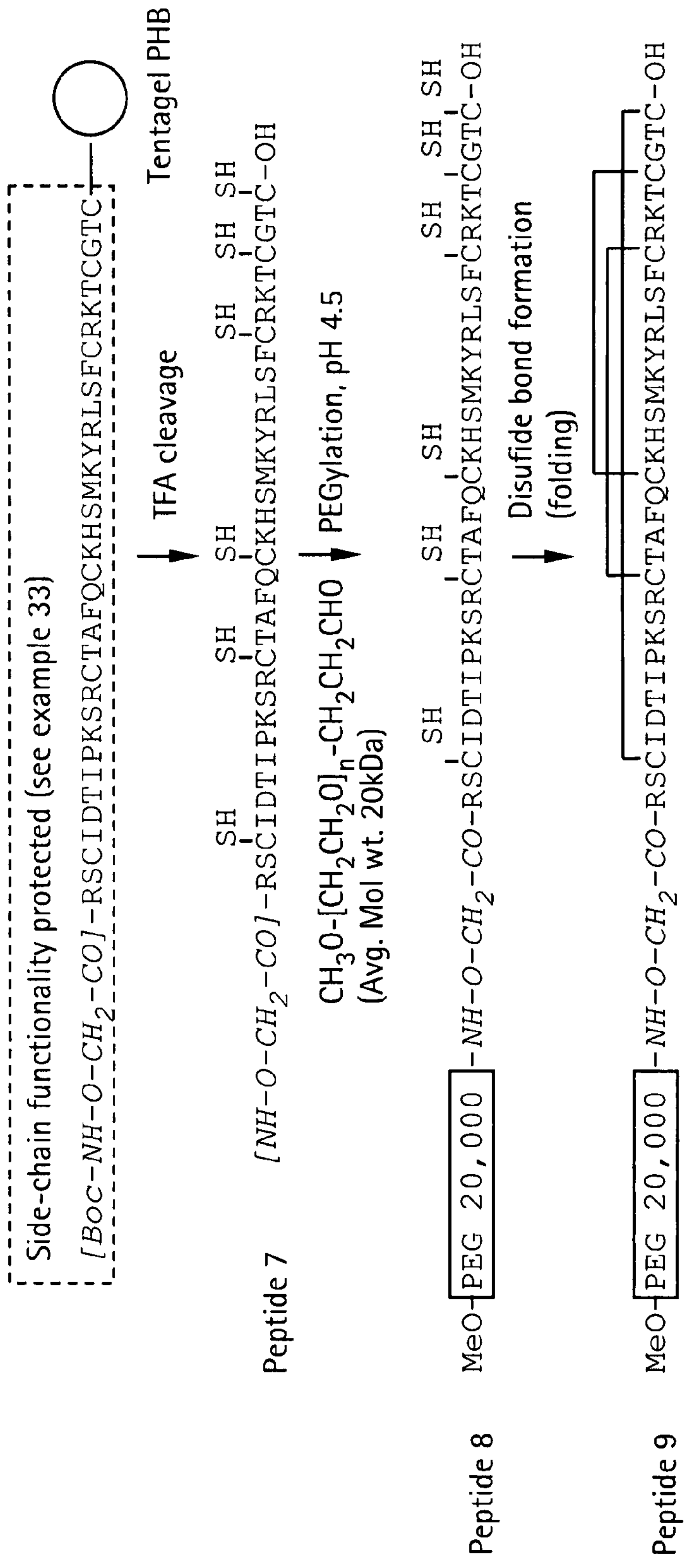
FIG. 19 shows a scheme for N-terminal PEGylation of ShK peptide (SEQ ID NO: 5 and SEQ ID NO:10) by chemoselective oxime formation, which is also described in Example 33 hereinafter.

The experimental procedures of this working example correspond to the results shown in FIG. 18.

N-Terminal PEGylation of Shk by Amide Formation. A 10 mg/mL solution of folded Shk (Peptide 5), in 100 mM Bicine pH 8.0, can be added to solid succinimidyl ester of 20 kDa PEG propionic acid (mPEG-SPA; $CH_3O-[CH_2CH_2O]n-CH_2CH_2CO-NHS$) at room temperature using a 1.5 molar excess of the mPEG-SPA to Shk. After one hour with gentle stirring, the mixture can be diluted to 2 mg/mL with water, and the pH can be adjusted to 4.0 with dilute HCl. The extent of mono-pegylated Shk (Peptide 10), some di-PEGylated Shk or tri-PEGylated Shk, unmodified Shk and succinimidyl ester hydrolysis can be determined by SEC HPLC using a Superdex™ 75 HR 10/30 column (Amersham) eluted with 0.05 M $NaH_2PO_4$, 0.05 M $Na_2HPO_4$, 0.15 M NaCl, 0.01 M $NaN_3$, pH 6.8, at 1 mL/min. The fractions can be analyzed using a 4-20 tris-Gly SDS-PAGE gel and RP-HPLC. SDS-PAGE gels can be run for 1.5 hours at 125 V, 35 mA, 5 W. Pooled product can be then dialyzed at 4° C. in 3 changes of 1 L of A4S buffer (10 mM NaOAc, 5% sorbitol, pH 4.0). The dialyzed N-terminally PEGylated (amidated) ShK (Peptide 10) can be then concentrated in 10 K microcentrifuge filter to 2 mL volume and sterile-filtered using 0.2 μM syringe filter to give the final product.

Example 35

Fc-L-SmIIIA

Fc-SmIIIA expression vector. A 104 bp BamHI-NotI fragment containing partial linker sequence and SmIIIA peptide encoded with human high frequency codons was assembled by PCR with overlapping primers 3654-50 and 3654-51 and cloned into to the 7.1 kb NotI-BamHI back bone to generate pcDNA3.1(+) CMVi-hFc-SmIIIA as described in Example 1.

```
   BamHI
5' GGATCCGGAGGAGGAGGAAGCTGCTGCAACGGC SEQ ID NO: 872
                           C  C  N  G   SEQ ID NO:873
CGCCGCGGCTGCAGCAGCCGCTGGTGCCGCGACCAC
R  R  G  C  S  S  R  W  C  R  D  H
AGCCGCTGCTGCTGAGCGGCCGC3' //
S  R  C  C       NotI
```

Forward 5'-3'
GGAGGAGGATCCGGAGGAGGAGGAAGCTGCTGCAAC SEQ ID NO: 874
GGCCGCCGCGGCTGCAGCAGC CGC //

Reverse 5'-3'
ATTATTGCGGCCGCTCAGCAGCAGCGGCTGTGGTCG SEQ ID NO: 875
CGGCACCAGCGGCTGCTGCAG CCGC The sequences of the BamHI to NotI fragments in the final constructs were verified by sequencing.

Figure 25A:
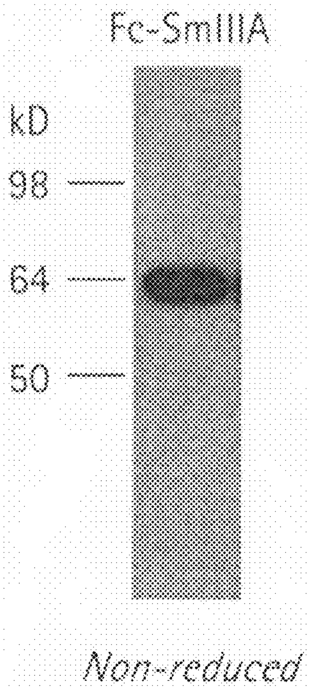
FIG. 25A shows a western blot of a non-reducing SDS-PAGE gel containing conditioned medium from 293T cells transiently transfected with Fc-L-SmIIIA.
Figure 25B:
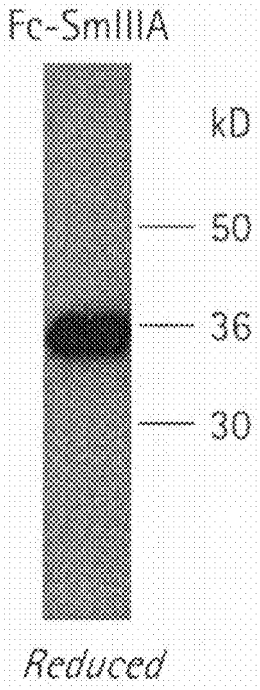
FIG. 25B shows a western blot of a reducing SDS-PAGE gel containing conditioned medium from 293T cells transiently transfected with Fc-L-SmIIIA.

Transient expression of Fc-L-SmIIIa. 7.5 ug of the toxin peptide Fc fusion construct pcDNA3.1(+) CMVi-hFc-SmIIIA were transfected into 293-T cells in 10 cm tissue culture plate with FuGENE 6 as transfection reagent. Culture medium was replaced with serum-free medium at 24 hours post-transfection and the conditioned medium was harvested at day 5 post-transfection. Transient expression of Fc-SmIIIA from 293-T cells was analyzed by Western blot probed with anti-hFc antibody (FIG. 25A and FIG. 25B). Single band of expressed protein with estimated MW was shown in both reduced and non-reduced samples. Transient expression level of Fc-SmIIIA was further determined to be 73.4 μg/ml according to ELISA.

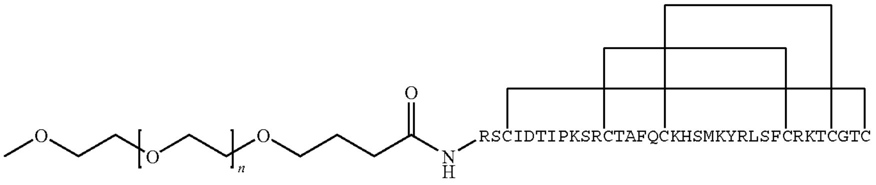

(Peptide 10, SEQ ID NO: 10)

Example 36

Electrophysiology Experiments

Cell Culture. Stable cell line expressing human Kv1.3 channel was licensed from Biofocus. Cells were kept at 37° C. in 5% $CO_2$ environment. Culture medium contains DMEM with GlutaMax™ (Invitrogen), 1× non-essential amino acid, 10% fetal bovine serum and 500 μg/mL geneticin. Cells were plated and grown at low confluence on 35 mm culture dishes for at least 24 hours prior to electrophysiology experiments.

Electrophysiology Recording by Patch Clamping. Whole-cell currents were recorded from single cells by using tight seal configuration of the patch-clamp technique. A 35 mm culture dish was transferred to the recording stage after rinsing and replacing the culture medium with recording buffer containing 135 mM NaCl, 5 mM KCl, 1.8 mM $CaCl_2$, 10 mM HEPES, and 5 mM Glucose. pH was adjusted to 7.4 with NaOH and the osmolarity was set at 300 mOsm. Cells were perfused continuously with the recording buffer via one of the glass capillaries arranged in parallel and attached to a motorized rod, which places the glass capillary directly on top of the cell being recorded. Recording pipette solution contained 90 mM K-gluconate, 20 mM KF, 10 mM NaCl, 1 mM $MgCl_2$-$6H_2O$, 10 mM EGTA, 5 mM K2-ATP, and 10 mM HEPES. The pH for the internal solution was adjusted to 7.4 with KOH and the osmolarity was set at 280 mOsm. Experiments were performed at room temperature (20-22° C.) and recorded using Multiclamp™ 700 Å amplifier (Molecular Devices Inc.). Pipette resistances were typically 2-3 MΩ.

Protein toxin potency determination on Kv1.3 current: HEK293 cells stably expressing human Kv1.3 channel were voltage clamped at −80 mV holding potential. Outward Kv1.3 currents were activated by giving 200 msec long depolarizing steps to +30 mV from the holding potential of −80 mV and filtered at 3 kHz. Each depolarizing step was separated from the subsequent one with a 10 s interval. Analogue signals were digitized by Digidata™ 1322A digitizer (Molecular Devices) subsequently stored on computer disk for offline analyses using Clampfit™ 9 (Molecular Devices Inc.). In all studies, stable baseline Kv1.3 current amplitudes were established for 4 minutes before starting the perfusion of the protein toxin at incremental concentrations. A steady state block was always achieved before starting the perfusion of the subsequent concentration of the protein toxin.

Data analysis. Percent of control (POC) is calculated based on the following equation: (Kv1.3 current after protein toxin addition/Kv1.3 current in control)*100. At least 5 concentrations of the protein toxin (e.g. 0.003, 0.01, 0.03, 0.1, 0.3, 100 nM) were used to calculate the $IC_{50}$ value. $IC_{50}$ values and curve fits were estimated using the four parameter logistic fit of XLfit software (Microsoft Corp.). $IC_{50}$ values are presented as mean value±s.e.m. (standard error of the mean).

Drug preparations. Protein toxins (typically 10-100 μM) were dissolved in distilled water and kept frozen at −80° C. Serial dilutions of the stock protein toxins were mixed into the recording buffer containing 0.1% bovine serum albumin (BSA) and subsequently transferred to glass perfusion reservoirs. Electronic pinch valves controlled the flow of the protein toxin from the reservoirs onto the cell being recorded.

Example 37

Immunobiology and Channel Binding

Inhibition of T cell cytokine Production following PMA and anti-CD3 antibody stimulation of PBMCs. PBMC's were previously isolated from normal human donor Leukophoresis packs, purified by density gradient centrifugation (Ficoll Hypaque), cryopreserved in CPZ Cryopreservation Medium Complete (INCELL, MCPZF-100 plus 10% DMSO final). PBMC's were thawed (95% viability), washed, and seeded at $2\times10^5$ cells per well in culture medium (RPMI medium 1640; GIBCO) supplemented with 10% fetal calf serum, 100 U/ml penicillin, 100 mg/ml streptomycin 2 mM L-glutamine, 100 uM non-essential amino acids, and 20 uM 2-ME) in 96-well flat-bottom tissue culture plates. Cells were pre-incubated with serially diluted (100 nM-0.001 nM final) ShK[1-35], Fc-L10-ShK[1-35] or fc control for 90 min before stimulating for 48 hr with PMA/anti-CD3 (1 ng/ml and 50 ng/ml, respectively) in a final assay volume of 200 ul. Analysis of the assay samples was performed using the Meso Scale Discovery (MSD) SECTOR™ Imager 6000 (Meso Scale Discovery, Gaithersbury, Md.) to measure the IL-2 and IFNg protein levels by utilizing electrochemiluminescence (ECL). The conditioned medium (50 ul) was added to the MSD Multi-spot 96-well plates (each well containing three capture antibodies; IL-2, TNF, IFNγ). The plates were sealed, wrapped in tin foil, and incubated at room temperature on a plate shaker for 2 hr. The wells were washed 1× with 200 ul PBST (BIOTEK, Elx405 Auto Plate Washer). For each well, 20 ul of Ruthenium-labeled detection antibodies (1 μg/ml final in Antibody Dilution Buffer; IL-1, TNF, IFNγ) and 130 ul of 2×MSD Read Buffer added, final volume 150 ul. The plates were sealed, wrapped in tin foil, and incubated at room temperature on a plate shaker for 1 hr. The plates were then read on the SECTOR™ Imager 6000. FIGS. 35A & 35B shows the CHO-derived Fc-L10-ShK[1-35] peptibody potently inhibits IL-2 and IFNg production from T cells in a dose-dependent manner. Compared to native ShK[1-35] peptide, the peptibody produces a greater extent of inhibition (POC=Percent Of Control of response in the absence of inhibitor).

Inhibition of T cell cytokine production following anti-CD3 and anti-CD28 antibody stimulation of PBMCs. PBMCs were previously isolated from normal human donor Leukopheresis packs, purified by density gradient centrifugation (Ficoll Hypaque), and cryopreserved using INCELL Freezing Medium. PBMCs were thawed (95% viability), washed, and seeded (in RPMI complete medium containing serum replacement, PSG) at $2\times10^5$ cells per well into 96-well flat bottom plates. Cells were pre-incubated with serially diluted (100 nM-0.003 nM final) ShK[1-35], Fc-L10-ShK[1-35], or Fc control for 1 hour before the addition of aCD3 and aCD28 (2.5 ng/mL and 100 ng/mL respectively) in a final assay volume of 200 mL. Supernatants were collected after 48 hours, and analyzed using the Meso Scale Discovery (MSD) SECTOR™ Imager 6000 (Meso Scale Discovery, Gaithersbury, Md.) to measure the IL-2 and IFNg protein levels by utilizing electrochemiluminescence (ECL). 20 mL of supernatant was added to the MSD multi-spot 96-well plates (each well containing IL-2, TNFa, and IFNg capture antibodies). The plates were sealed and incubated at room temperature on a plate shaker for 1 hour. Then 20 mL of Ruthenium-labeled detection antibodies (1 μg/ml final of IL-2, TNFα, and IFNγ in Antibody Dilution Buffer) and 110 mL of 2×MSD Read Buffer were added. The plates were sealed, covered with tin foil, and incubated at room temperature on a plate shaker for 1 hour. The plates were then read on the SECTOR™ Imager 6000. FIGS. 37A & 37B shows the CHO-derived Fc-L10-ShK[1-35] peptibody potently inhibits IL-2 and IFNg production from T cells in a dose-dependent manner. Compared to native ShK[1-35] peptide which shows only partial inhibition, the peptibody produces nearly complete inhibition of the inflammatory cytokine response. (POC=Percent Of Control of response in the absence of inhibitor).

Inhibition of T cell proliferation following anti-CD3 and anti-CD28 antibody stimulation of PBMCs. PBMC's were previously isolated from normal human donor Leukophoresis packs, purified by density gradient centrifugation (Ficoll Hypaque), cryopreserved in CPZ Cryopreservation Medium Complete (INCELL, MCPZF-100 plus 10% DMSO final). PBMC's were thawed (95% viability), washed, and seeded at $2\times10^5$ cells per well in culture medium (RPMI medium 1640; GIBCO) supplemented with 10% fetal calf serum, 100 U/ml penicillin, 100 mg/ml streptomycin, 2 mM L-glutamine, 100 μM non-essential amino acids, and 20 μM 2-ME) in 96-well flat-bottom tissue culture plates. Cells were pre-incubated with either anti-human CD32 (FcγRII) blocking antibody (per manufacturers instructions EASY SEP Human Biotin Selection Kit #18553, StemCell Technologies Vancouver, BC) or Fc-L10-ShK (100 nM-0.001 nM final) for 45 min. Fc-L10-ShK (100 nM-0.001 nM final) was then added to the cells containing anti-human CD32 blocking antibody while medium was added to the cells containing Fc-L10-ShK. Both sets were incubated for an additional 45 min before stimulating for 48 hr with aCD3/aCD28 (0.2 ng/ml and 100 ng/ml, respectively). Final assay volume was 200 ul. [3H]TdR (1 uCi per well) was added and the plates were incubated for an additional 16 hrs. Cells were then harvested onto glass fiber filters and radioactivity was measured in a B-scintillation counter. FIGS. 36A & 36B shows the CHO-derived Fc-L10-ShK[1-35] peptibody potently inhibits proliferation of T cells in a dose-dependent manner. Pre-blocking with the anti-CD32 (FcR) blocking antibody has little effect on the peptibodies ability to inhibit T cell proliferation suggesting Kv1.3 inhibition and not FcR binding is the mechanism for the inhibition observed (POC=Percent Of Control of response in the absence of inhibitor).

Immunohistochemistry analysis of Fc-L10-ShK[1-35] binding to HEK 293 cells overexpressing human Kv1.3. HEK 293 cells overexpressing human Kv1.3 (HEK Kv1.3) were obtained from BioFocus plc (Cambridge, UK) and maintained per manufacturer's recommendation. The parental HEK 293 cell line was used as a control. Cells were plated on Poly-D-Lysine 24 well plates (#35-4414; Becton-Dickinson, Bedford, Mass.) and allowed to grow to approximately 70% confluence. HEK KV1.3 were plated at 0.5×10e5 cells/well in 1 ml/well of medium. HEK 293 cells were plated at a density of 1.5×10e5 cells/well in 1 ml/well of medium. Before staining, cells were fixed with formalin (Sigma HT50-1-1 Formalin solution, diluted 1:1 with PBS/0.5% BSA before use) by removing cell growth medium, adding 0.2 ml/well formalin solution and incubating at room temperature for ten minutes. Cells were stained by incubating with 0.2 ml/well of 5 μg/ml Fc-L10-ShK[1-35] in PBS/BSA for 30' at room temperature. Fc-L10-ShK[1-35] was aspirated and then the cells were washed one time with PBS/0.5% BSA. Detection antibody (Goat F(ab)$_2$ anti-human IgG-phycoerythrin; Southern Biotech Associates, Birmingham, Ala.) was added to the wells at 5 μg/ml in PBS/0.5% BSA and incubated for 30' at room temperature. Wash cells once with PBS/0.5% BSA and examine using confocal microscopy (LSM 510 Meta Confocal Microscope; Carl Zeiss AG, Germany). FIG. 33B shows the Fc-L10-ShK[1-35] peptibody retains binds to Kv1.3 overexpressing HEK 293 cells but shows little binding to untransfected cells (FIG. 33A) indicating the Fc-L10-ShK[1-35] peptibody can be used as a reagent to detect cells overexpressing the Kv1.3 channel. In disease settings where activated T effector memory cells have been reported to overproduce Kv1.3, this reagent can find utility in both targeting these cells and in their detection.

An ELISA assay demonstrating Fc-L10-ShK[1-35] binding to fixed HEK 293 cells overexpressing Kv1.3. FIG. 34A shows a dose-dependent increase in the peptibody binding to fixed cells that overexpress Kv1.3, demonstrating that the peptibody shows high affinity binding to its target and the utility of the Fc-L10-ShK[1-35] molecule in detection of cells expressing the channel. Antigen specific T cells that cause disease in patients with multiple sclerosis have been shown to overexpress Kv1.3 by whole cell patch clamp electrophysiology, —a laborius approach. Our peptibody reagent can be a useful and convenient tool for monitoring Kv1.3 channel expression in patients and have utility in diagnostic applications. The procedure shown in FIG. 34A and FIG. 34B follows.

FIG. 34A. A whole cell immunoassay was performed to show binding of intact Fc-L10-ShK[1-35] to Kv1.3 transfected HEK 293 cells (BioFocus plc, Cambridge, UK). Parent HEK 293 cells or HEK Kv1.3 cells were plated at 3×10e4 cells/well in poly-D-Lysine coated ninety-six well plates (#35-4461; Becton-Dickinson, Bedford, Mass.). Cells were fixed with formalin (Sigma HT50-1-1 Formalin solution, diluted 1:1 with PBS/0.5% BSA before use) by removing cell growth medium, adding 0.2 ml/well formalin solution and incubating at room temperature for 25 minutes and then washing one time with 100 μl/well of PBS/0.5% BSA. Wells were blocked by addition of 0.3 ml/well of BSA blocker (50-61-00; KPL 10% BSA Diluent/Blocking Solution, diluted 1:1 with PBS; KPL, Gaithersburg, Md.) followed by incubation at room temperature, with shaking, for 3 hr. Plates were washed 2 times with 1×KP Wash Buffer (50-63-00; KPL). Samples were diluted in Dilution Buffer (PBS/0.5% Tween-20) or Dilution Buffer with 1% Male Lewis Rat Serum (RATSRM-M; Bioreclamation Inc., Hicksville, N.Y.) and 0.1 ml/well was added to blocked plates, incubating for 1 hr at room temperature with shaking. Plates were washed 3 times with 1xKP Wash Buffer and then incubated with HRP-Goat anti-human IgG Fc (#31416; Pierce, Rockford, Ill.) diluted 1:5000 in PBS/0.1% Tween-20 for 1 hr at room temperature, with shaking. Plates were washed plates 3 times with 1xKP Wash Buffer, and then 0.1 ml/well TMB substrate (52-00-01; KPL) was added. The reactions were stopped by addition of 0.1 ml/well 2 N Sulfuric Acid. Absorbance was read at 450 nm on a Molecular Devices SpectroMax 340 (Sunnyvale, Calif.).

FIG. 34B. Whole cell immunoassay was performed as above with the following modifications. HEK 293 cells were plated at 1×10e5 cells/well and HEK Kv1.3 cells were plated at 6×10e4 cells/well in poly-D-Lysine coated 96 well plates. Fc Control was added at 500 ng/ml in a volume of 0.05 ml/well. HRP-Goat anti-human IgG Fc (#31416; Pierce, Rockford, Ill.) was diluted 1:10,000 in PBS/0.1% Tween-20. ABTS (50-66-00, KPL) was used as the substrate. Absorbances were read at 405 nm after stopping reactions by addition of 0.1 ml/well of 1% SDS.

Example 38

Purification of Fc-L10-ShK(1-35)

Expression of Fc-L10-ShK[1-35] was as described in Example 3 herein above. Frozen, *E. coli* paste (18 g) was combined with 200 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 15 min at 4° C. The pellet was then resuspended in 200 ml 1% deoxycholic acid using a tissue grinder and then centrifuged at 22,000 g for 15 min at 4° C. The pellet was then resuspended in 200 ml water using a tissue grinder and then centrifuged at 22,000 g for 15 min at 4° C. The pellet (3.2 g) was then dissolved in 32 ml 8 M guanidine HCl, 50 mM tris HCl, pH 8.0. The pellet solution was then centrifuged at 27,000 g for 15 min at room temperature, and then 5 ml of the supernatant was transferred to 500 ml of the refolding buffer (3 M urea, 20% glycerol, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then stored at −70° C.

The stored refold was defrosted and then diluted with 2 L of water and the pH was adjusted to 7.3 using 1 M $H_3PO_4$. The pH adjusted material was then filtered through a 0.22 μm cellulose acetate filter and loaded on to a 60 ml Amersham SP-FF (2.6 cm I.D.) column at 20 ml/min in S-Buffer A (20 mM NaH2PO4, pH 7.3) at 7° C. The column was then washed with several column volumes of S-Buffer A, followed by elution with a linear gradient from 0% to 60% S-Buffer B (20 mM NaH2PO4, 1 M NaCl, pH 7.3) followed by a step to 100% S-Buffer B at 10 ml/min 7° C. Fractions were then analyzed using a Coomassie brilliant blue stained tris-glycine 4-20% SDS-PAGE, and the fractions containing the desired product were pooled based on these data. The pool was then loaded on to a 1 ml Amersham rProtein A HiTrap column in PBS at 1 ml/min 7° C. Then column was then washed with several column volumes of 20 mM $NaH_2PO_4$ pH 6.5, 1 M NaCl and eluted with 100 mM glycine pH 3.0. To the elution peak, 0.0125 volumes (25 ml) of 3 M sodium acetate was added.

A spectral scan was then conducted on 50 μl of the combined pool diluted in 700 μl water using a Hewlett Packard 8453 spectrophotometer (FIG. 46A). The concentration of the filtered material was determined to be 2.56 mg/ml using a calculated molecular mass of 30,410 g/mol and extinction coefficient of 36,900 M−1 cm−1. The purity of the filtered material was then assessed using a Coomassie brilliant blue stained tris-glycine 4-20% SDS-PAGE (FIG. 46B). The macromolecular state of the product was then determined using size exclusion chromatography on 20 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 46C). The product was then subject to mass spectral analysis by diluting 1 μl of the sample into 10 μl of sinapinic acid (10 mg per ml in 0.05% trifluoroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses. The product was then stored at −80° C.

The $IC_{50}$ for blockade of human Kv1.3 by purified *E. coli*-derived Fc-L10-ShK[1-35], also referred to as "Fc-L-ShK[1-35]", is shown in Table 35 (in Example 50 herein below).

Example 39

Purification of Bacterially Expressed Fc-L10-ShK(2-35)

Expression of Fc-L10-ShK[2-35] was as described in Example 4 herein above. Frozen, *E. coli* paste (16.5 g) was combined with 200 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 22,000 g for 15 min at 4° C. The pellet was then resuspended in 200 ml 1% deoxycholic acid using a tissue grinder and then centrifuged at 22,000 g for 15 min at 4° C. The pellet was then resuspended in 200 ml water using a tissue grinder and then centrifuged at 22,000 g for 15 min at 4° C. The pellet (3.9 g) was then dissolved in 39 ml 8 M guanidine HCl, 50 mM tris HCl, pH 8.0. The pellet solution was then centrifuged at 27,000 g for 15 min at room temperature, and then 5 ml of the supernatant was transferred to 500 ml of the refolding buffer (3 M urea, 20% glycerol, 50 mM tris, 160 mM arginine HCl, 5 mM EDTA, 1 mM cystamine HCl, 4 mM cysteine, pH 9.5) at 4° C. with vigorous stirring. The stirring rate was then slowed and the incubation was continued for 2 days at 4° C. The refolding solution was then stored at −70° C.

The stored refold was defrosted and then diluted with 2 L of water and the pH was adjusted to 7.3 using 1 M $H_3PO_4$. The pH adjusted material was then filtered through a 0.22 μm cellulose acetate filter and loaded on to a 60 ml Amersham SP-FF (2.6 cm I.D.) column at 20 ml/min in S-Buffer A (20 mM $NaH_2PO_4$, pH 7.3) at 7° C. The column was then washed with several column volumes of S-Buffer A, followed by elution with a linear gradient from 0% to 60% S-Buffer B (20 mM NaH2PO4, 1 M NaCl, pH 7.3) followed by a step to 100% S-Buffer B at 10 ml/min 7° C. The fractions containing the desired product were pooled and filtered through a 0.22 μm cellulose acetate filter. The pool was then loaded on to a 1 ml Amersham rProtein A HiTrap column in PBS at 2 ml/min 7° C. Then column was then washed with several column volumes of 20 mM $NaH_2PO_4$ pH 6.5, 1 M NaCl and eluted with 100 mM glycine pH 3.0. To the elution peak, 0.0125 volumes (18 ml) of 3 M sodium acetate was added, and the sample was filtered through a 0.22 μm cellulose acetate filter.

A spectral scan was then conducted on 20 μl of the combined pool diluted in 700 μl water using a Hewlett Packard 8453 spectrophotometer (FIG. 40A). The concentration of the filtered material was determined to be 3.20 mg/ml using a calculated molecular mass of 29,282 g/mol and extinction coefficient of 36,900 $M^{-1}$ $cm^{-1}$. The purity of the filtered material was then assessed using a Coomassie brilliant blue stained tris-glycine 4-20% SDS-PAGE (FIG. 40B). The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 40C). The product was then subject to mass spectral analysis by diluting 1 μl of the sample into 10 μl of sinapinic acid (10 mg per ml in 0.05% trifluoroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses (FIG. 40D). The product was then stored at −80° C.

The $IC_{50}$ for blockade of human Kv1.3 by purified *E. coli*-derived Fc-L10-ShK[2-35], also referred to as "Fc-L-ShK[2-35]", is shown in Table 35 (in Example 50 herein below).

Example 40

Purification of Bacterially Expressed Fc-L10-OsK1

Frozen, *E. coli* paste (129 g; see Example 10) was combined with 1290 ml of room temperature 50 mM tris HCl, 5 mM EDTA, pH 7.8 and was brought to about 0.1 mg/ml hen egg white lysozyme. The suspended paste was passed through a chilled microfluidizer twice at 12,000 PSI. The cell lysate was then centrifuged at 17,700 g for 15 min at 4° C. The pellet was then resuspended in 1290 ml 1% deoxycholic acid using a tissue grinder and then centrifuged at 17,700 g for 15 min at 4° C. The pellet was then resuspended in 1290 ml water using a tissue grinder and then centrifuged at 17,700 g for 15 min at 4° C. 8 g of the pellet (16.3 g total) was then dissolved in 160 ml 8 M guanidine HCl, 50 mM tris HCl, pH 8.0. 100 ml of the pellet solution was then incubated with 1 ml of 1 M DTT for 60 min at 37° C. The reduced material was transferred to 5000 ml of the refolding buffer (1 M urea, 50 mM tris, 160 mM arginine HCl, 2.5 mM EDTA, 1.2 mM cystamine HCl, 4 mM cysteine, pH 10.5) at 2 ml/min, 4° C. with vigorous stirring. The stirring rate was then slowed and the incubation was continued for 3 days at 4° C.

The pH of the refold was adjusted to 8.0 using acetic acid. The pH adjusted material was then filtered through a 0.22 μm cellulose acetate filter and loaded on to a 50 ml Amersham Q Sepharose-FF (2.6 cm I.D.) column at 10 ml/min in Q-Buffer A (20 mM Tris, pH 8.5) at 8° C. with an inline 50 Amersham Protein A column (2.6 cm I.D.). After loading, the Q Sepharose column was removed from the circuit, and the remaining chromatography was carried out on the protein A column. The column was washed with several column volumes of Q-Buffer A, followed by elution using a step to 100 mM glycine pH 3.0. The fractions containing the desired product were pooled and immediately loaded on to a 50 ml Amersham SP-Sepharose HP column (2.6 cm I.D.) at 20 ml/min in S-Buffer A (20 mM $NaH_2PO_4$, pH 7.0) at 8° C. The column was then washed with several column volumes of S-Buffer A followed by a linear gradient from 5% to 60% S-Buffer B (20 mM $NaH_2PO_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled and then applied to a 75 ml MEP Hypercel column (2.6 cm I.D.) at 5 ml/min in MEP Buffer A (20 mM tris, 200 mM NaCl, pH 8.0) at 8° C. Column was eluted with a linear gradient from 5% to 50% MEP Buffer B (50 mM sodium citrate pH 4.0) followed by a step to 100% MEP Buffer B. Fractions were then analyzed using a Coomassie brilliant blue stained tris-glycine 4-20% SDS-PAGE, and the fractions containing the bulk of the desired product were pooled.

The MEP pool was then concentrated to about 20 ml using a Pall Jumbo-Sep with a 10 kDa membrane followed by buffer exchange with Formulation Buffer (20 mM $NaH_2PO_4$, 200 mM NaCl, pH 7.0) using the same membrane. A spectral scan was then conducted on 50 μl of the combined pool diluted in 700 μl Formulation Buffer using a Hewlett Packard 8453 spectrophotometer (FIG. 41A). The concentration of the material was determined to be 4.12 mg/ml using a calculated molecular mass of 30,558 g/mol and extinction coefficient of 35,720 $M^{-1}$ $cm^{-1}$. The purity of the material was then assessed using a Coomassie brilliant blue stained tris-glycine 4-20% SDS-PAGE (FIG. 41B). The macromolecular state of the product was then determined using size exclusion chromatography on 123 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 41C). The product was then subject to mass spectral analysis by chromatographing approximately 4 μg of the sample through a RP-HPLC column (Vydac $C_4$, 1×150 mm). Solvent A was 0.1% trifluoroacetic acid in water and solvent B was 0.1% trifluoroacetic acid in 90% acetonitrile, 10% water. The column was pre-equilibrated in 10% solvent B at a flow rate of 80 μl per min. The protein was eluted using a linear gradient of 10% to 90% solvent B over 30 min. Part of the effluent was directed into a LCQ ion trap mass spectrometer. The mass spectrum was deconvoluted using the Bioworks software provided by the mass spectrometer manufacturer. (FIG. 41D). The product was filtered through a 0.22 μm cellulose acetate filter and then stored at −80° C.

The yield for the *E. coli*-expressed Fc-L10-OSK1 prep was 81 mg from 40 g of cell paste (129 g×(8 g/16.3 g)×(100 ml/160 ml)=39.6 g which was rounded to 40 g), the purity was greater than 80% judging by SDS-PAGE, it is running as the expected dimer judging by SEC-HPLC, and the mass was within the expected molecular weight range judging by MS.

The $IC_{50}$ for blockade of human Kv1.3 by purified *E. coli*-derived Fc-L10-OSK1, also referred to as "Fc-L-OSK1", is shown in Table 35 (in Example 50 herein below).

Example 41

Fc-L10-OSK1, Fc-L10-OSK1[K7S], Fc-L10-OSK1[E16K,K20D], and Fc-L10-OSK1 [K7S,E16K,K20D] Expressed by Mammalian Cells Fc-L10-OSK1, Fc-L10-OSK1[K7S], Fc-L10-OSK1 [E16K,K20D], and Fc-L10-OSK1 [K7S,E16K,K20D], inhibitors of Kv1.3, were expressed in mammalian cells. A DNA sequence coding for the Fc region of human IgG1 fused in-frame to a linker sequence and a monomer of the Kv1.3 inhibitor peptide OSK1, OSK1[K7S], OSK1[E16K,K20D], or OSK1[K7S,E16K,K20D] was constructed as described below. Methods for expressing and purifying the peptibody from mammalian cells (HEK 293 and Chinese Hamster Ovary cells) are disclosed herein.

For construction of Fc-L10-OSK1, Fc-L10-OSK1[K7S], Fc-L10-OSK1[E16K,K20D], and Fc-L10-OSK1[K7S, E16K,K20D] expression vectors, a PCR strategy was employed to generate the full length genes, OSK1, OSK1 [K7S], OSK1[E16K,K20D], and OSK1[K7S,E16K,K20D], each linked to a four glycine and one serine amino acid linker with two stop codons and flanked by BamHI and NotI restriction sites as shown below.

Two oligos for each of OSK1, OSK1[K7S], OSK1[E16K, K20D], and [K7S,E16K,K20D]OSK1 with the sequence as depicted below were used in a PCR reaction with Pfu Turbo HotStart DNA polymerase (Stratagene) at 95° C.-30 sec, 55° C.-30 sec, 75° C.-45 sec for 35 cycles; BamHI (ggatcc) and NotI (gcggccgc) restriction sites are underlined.

```
OSK1:
Forward primer:
                                        (SEQ ID NO: 876)
cat gga tcc gga gga gga gga agc ggc gtg atc atc
aac gtg aag tgc aag atc agc cgc cag tgc ctg gag
ccc tgc aag aag gcc g;

Reverse primer:
                                        (SEQ ID NO: 877)
cat gcg gcc gct tac tac ttg ggg gtg cag tgg cac
ttg ccg ttc atg cac ttg ccg aag cgc atg ccg gcc
ttc ttg cag ggc tcc a;

OSK1 [K7S]:
Forward primer:
                                        (SEQ ID NO: 878)
cat gga tcc gga gga gga gga agc ggc gtg atc atc
aac gtg agc tgc aag atc agc cgc cag tgc ctg gag
ccc tgc aag aag gcc g;

Reverse primer:
                                        (SEQ ID NO: 879)
cat gcg gcc gct tac tac ttg ggg gtg cag tgg cac
ttg ccg ttc atg cac ttg ccg aag cgc atg ccg gcc
ttc ttg cag ggc tcc a;
```

-continued

```
OSK1 [E16K,K20D]:
Forward primer:
                                                  (SEQ ID NO: 880)
cat gga tcc gga gga gga gga agc ggc gtg atc atc
aac gtg aag tgc aag atc agc cgc cag tgc ctg aag
ccc tgc aag gac gcc g;

Reverse primer:
                                                  (SEQ ID NO: 881)
cat gcg gcc gct tac tac ttg ggg gtg cag tgg cac
ttg ccg ttc atg cac ttg ccg aag cgc atg ccg gcg
tcc ttg cag ggc ttc a;

OSK1 [K7S,E16K,K20D]:
Forward primer:
                                                  (SEQ ID NO: 882)
cat gga tcc gga gga gga gga agc ggc gtg atc atc
aac gtg agc tgc aag atc agc cgc cag tgc ctg aag
ccc tgc aag gac gcc g;

Reverse primer:
                                                  (SEQ ID NO: 883)
cat gcg gcc gct tac tac ttg ggg gtg cag tgg cac
ttg ccg ttc atg cac ttg ccg aag cgc atg ccg gcg
tcc ttg cag ggc ttc a.
```

The resulting PCR products were resolved as the 155 bp bands on a four percent agarose gel. The 155 bp PCR product was purified using PCR Purification Kit (Qiagen), then digested with BamHI and NotI (Roche) restriction enzymes, and agarose gel was purified by Gel Extraction Kit (Qiagen). At the same time, the pcDNA3.1(+) CMVi-hFc-Shk[2-35] vector was digested with BamHI and NotI restriction enzymes and the large fragment was purified by Gel Extraction Kit. The gel purified PCR fragment was ligated to the purified large fragment and transformed into One Shot® Top 10F' (Invitrogen). DNAs from transformed bacterial colonies were isolated and digested with BamHI and NotI restriction enzymes and resolved on a two percent agarose gel. DNAs resulting in an expected pattern were submitted for sequencing. Although, analysis of several sequences of clones yielded a 100% percent match with the above sequences, only one clone from each gene was selected for large scaled plasmid purification. The DNA of Fc-L10-OSK1, Fc-L10-OSK1 [K7S], Fc-L10-OSK1[E16K,K20D], and Fc-L10-OSK1 [K7S,E16K,K20D] in pCMVi vector was resequenced to confirm the Fc and linker regions and the sequence was 100% identical to the above sequences. The sequences and pictorial representations of Fc-L10-OSK1, Fc-L10-OSK1[K7S], Fc-L10-OSK1[E16K,K20D], and Fc-L10-OSK1[K7S, E16K,K20D] are depicted in FIG. 42A-B, FIG. 43A-B, FIG. 44A-B and FIG. 45A-B, respectively.

HEK-293 cells used in transient transfection expression of Fc-L110-OSK1, Fc-L10-OSK1[K7S], Fc-L10-OSK1[E16K, K20D], and Fc-L10-OSK1[K7S,E16K,K20D] in pCMVi protein were cultured in growth medium containing DMEM High Glucose (Gibco), 10% fetal bovine serum (FBS from Gibco), 1× non-essential amino acid (NEAA from Gibco) and 1× Penicillin/Streptomycine/Glutamine (Pen/Strep/Glu from Gibco). 5.6 μg each of Fc-L10-OSK1, Fc-L10-OSK1[K7S], Fc-L10-OSK1[E16K,K20D], and Fc-L10-OSK1[K7S, E16K,K20D] in pCMVi plasmid that had been phenol/chloroform extracted was transfected into HEK-293 cells using FuGENE 6 (Roche). The cells were recovered for 24 hours, and then placed in DMEM High Glucose, 1×NEAA and 1× Pen/Strep/Glu medium for 48 hours. Fc-L10-OSK1[K7S], Fc-L10-OSK1[E16K,K20D], and Fc-L10-OSK1[K7S, E16K,K20D] were purified from medium conditioned by these transfected HEK-293 cells using a protocol described in Example 50 herein below.

Fifteen μl of conditioned medium was mixed with an in-house 4× Loading Buffer (without β-mercaptoethanol) and electrophoresed on a Novex 4-20% tris-glycine gel using a Novex Xcell II apparatus at 101V/46 mA for 2 hours in a 1× Gel Running solution (25 mM Tris Base, 192 mM Glycine, 3.5 mM SDS) along with 20 μl of BenchMark Pre-Stained Protein ladder (Invitrogen). The gel was then soaked in Electroblot buffer (25 mM Tris base, 192 mM glycine, 20% methanol,) for 5 minutes. A nitrocellulose membrane from Invitrogen (Cat. No. LC200, 0.2 μm pores size) was soaked in Electroblot buffer. The pre-soaked gel was blotted to the nitrocellulose membrane using the Mini Trans-Blot Cell module according to the manufacturer instructions (Bio-Rad Laboratories) at 300 mA for 2 hours. The blot was rinsed in Tris buffered saline solution pH7.5 with 0.1% Tween20 (TBST). Then, the blot was first soaked in a 5% milk (Carnation) in TBST for 1 hour at room temperature, followed by washing three times in TBST for 10 minutes per wash. Then, incubated with 1:1000 dilution of the HRP-conjugated Goat anti-human IgG, (Fcγ) antibody (Pierece Biotechnology Cat. no. 31413) in TBST with 5% milk buffer for 1 hour with shaking at room temperature. The blot was then washed three times in TBST for 15 minutes per wash at room temperature. The primary antibody was detected using Amersham Pharmacia Biotech's ECL western blotting detection reagents according to manufacturers instructions. Upon ECL detection, the western blot analysis displayed the expected size of 66 kDa under non-reducing gel conditions (FIG. 46).

Plasmids containing the Fc-L10-OSK1, Fc-L10-OSK1 [K7S], Fc-L10-OSK1[E16K,K20D], and Fc-L10-OSK1 [K7S,E16K,K20D] inserts in pCMVi vector were digested with XbaI and NotI (Roche) restriction enzymes and gel purified. The inserts were individually ligated into SpeI and NotI (Roche) digested pDSRα24 (Amgen Proprietary) expression vector. Integrity of the resulting constructs were confirmed by DNA sequencing. Although, analysis of several sequences of clones yielded a 100% percent match with the above sequence, only one clone was selected for large scaled plasmid purification.

AM1 CHOd- (Amgen Proprietary) cells used in the stable expression of Fc-L10-OSK1 protein were cultured in AM1 CHOd-growth medium containing DMEM High Glucose, 10% fetal bovine serum, 1× hypoxantine/thymidine (HT from Gibco), 1×NEAA and 1× Pen/Strep/Glu. 5.6 μg of pDSRα-24-Fc-L10-OSK1 plasmid was transfected into AM1 CHOd-cells using FuGene 6. Twenty-four hours post transfection, the cells were split 1:11 into DHFR selection medium (DMEM High Glucose plus 10% Dialyzed Fetal Bovine Serum (dFBS), 1×NEAA and 1× Pen/Strep/Glu) at 1:50 dilution for colony selection. The cells were selected in DHFR selection medium for thirteen days. The ten 10-$cm^2$ pools of the resulting colonies were expanded to ten T-175 flasks, then were scaled up ten roller bottles and cultured under AM1 CHOd-production medium (DMEM/F12 (1:1), 1×NEAA, 1× Sodium Pyruvate (Na Pyruvate), 1× Pen/Strep/Glu and 1.5% DMSO). The conditioned medium was harvested and replaced at one-week intervals. The resulting six liters of conditioned medium were filtered through a 0.45 μm cellulose acetate filter (Corning, Acton, Mass.), and characterized by SDS-PAGE analysis as shown in FIG. 47. Then, transferred to Protein Chemistry for purification.

Twelve colonies were selected after 13 days on DHFR selection medium and picked into one 24-well plate. The plate was allowed to grow up for one week, and then was transferred to AM1 CHOd-production medium for 48-72 hours and the conditioned medium was harvested. The expression levels were evaluated by Western blotting similar to the transient Western blot analysis with detection by the same HRP-conjugated Goat anti-human IgG, (Fcγ) antibody to screen 5 μl of conditioned medium. All 12 stable clones exhibited expression at the expected size of 66 kDa. Two clones, A3 and C2 were selected and expanded to T175 flask for freezing with A3 as a backup to the primary clone C2 (FIG. 48).

The C2 clone was scaled up into fifty roller bottles (Corning) using selection medium and grown to confluency. Then, the medium was exchanged with a production medium, and let incubate for one week. The conditioned medium was harvested and replaced at the one-week interval. The resulting fifty liters of conditioned medium were filtered through a 0.45 μm cellulose acetate filter (Corning, Acton, Mass.), and characterized by SDS-PAGE analysis (data not shown). Further purification was accomplished as described in Example 42 herein below.

Example 42

Purification of Fc-L10-OSK1, Fc-L10-OSK1(K7S), Fc-L10-OSK1(E16K,K20D), and Fc-L10-OSK1 (K7S,E16K,K20D) Expressed by Mammalian Cells Purification of Fc-L10-OSK1. Approximately 6 L of CHO (AM1 CHOd-) cell-conditioned medium (see, Example 41 above) was loaded on to a 35 ml MAb Select column (GE Healthcare) at 10 ml/min 7° C., and the column was washed with several column volumes of Dulbecco's phosphate buffered saline without divalent cations (PBS) and sample was eluted with a step to 100 mM glycine pH 3.0. The MAb Select elution was directly loaded on to an inline 65 ml SP-HP column (GE Healthcare) in S-Buffer A (20 mM $NaH_2PO_4$, pH 7.0) at 10 ml/min 7° C. After disconnecting the MAb select column, the SP-HP column was then washed with several column volumes S-Buffer A, and then developed using a linear gradient from 5% to 60% S-Buffer B (20 mM $NaH_2PO_4$, 1 M NaCl, pH 7.0) at 10 ml/min followed by a step to 100% S-Buffer B at 7° C. Fractions were then analyzed using a Coomassie brilliant blue stained tris-glycine 4-20% SDS-PAGE, and the fractions containing the desired product were pooled based on these data. The pooled material was then concentrated to about 20 ml using a Pall Life Sciences Jumbosep 10K Omega centrifugal ultra-filtration device. The concentrated material was then buffer exchanged by diluting with 20 ml of 20 mM $NaH_2PO_4$, pH 7.0 and reconcentrated to 20 ml using the Jumbosep 10K Omega filter. The material was then diluted with 20 ml 20 mM $NaH_2PO_4$, 200 mM NaCl, pH 7.0 and then reconcentrated to 22 ml. The buffer exchanged material was then filtered though a Pall Life Sciences Acrodisc with a 0.22 μm, 25 mm Mustang E membrane at 1 ml/min room temperature. A spectral scan was then conducted on 50 μl of the filtered material diluted in 700 μl PBS using a Hewlett Packard 8453 spectrophotometer (FIG. 49A, black trace). The concentration of the filtered material was determined to be 4.96 mg/ml using a calculated molecular mass of 30,371 g/mol and extinction coefficient of 35,410 $M^{-1}$ $cm^{-1}$. The purity of the filtered material was then assessed using a Coomassie brilliant blue stained tris-glycine 4-20% SDS-PAGE (FIG. 49B). The endotoxin level was then determined using a Charles River Laboratories Endosafe-PTS system (0.05-5 EU/ml sensitivity) using a 30-fold dilution of the sample in Charles Rivers Laboratories Endotoxin Specific Buffer yielding a result of 1.8 EU/mg protein. The macromolecular state of the product was then determined using size exclusion chromatography on 149 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 49C). The product was then subject to mass spectral analysis by diluting 1 μl of the sample into 10 μl of sinapinic acid (10 mg per ml in 0.05% trifluoroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from about 200 laser shots. External mass calibration was accomplished using purified proteins of known molecular masses. (FIG. 49D). The product was then stored at −80° C.

The yield for the mammalian Fc-L10-OSK1 prep was 115 mg from 6 L, the purity was >90% judging by SDS-PAGE; Fc-L10-OSK1 ran as the expected dimer judging by SEC-HPLC, and the mass is with the expected range judging by MS.

The activity of purified Fc-L10-OSK1 in blocking human Kv1.3 and human Kv1.1 is described in Example 43 herein below.

Purification of Fc-L10-OSK1(K7S). Fc-L10-OSK1 (E16K,K20D), and Fc-L10-OSK1(K7S,E16K,K20D). Approximately 500 mL of medium conditioned by transfected HEK-293 (see, Example 41 above) was combined with a 65% slurry of MAb Select resin (1.5 ml) (GE Healthcare) and 500 μl 20% $NaN_3$. The slurry was then gently agitated for 3 days at 4° C. followed by centrifugation at 1000 g for 5 minutes at 4° C. using no brake. The majority of the supernatant was then aspirated and the remaining slurry in the pellet was transferred to a 14 ml conical tube and combined with 12 ml of Dulbecco's phosphate buffered saline without divalent cations (PBS). The slurry was centrifuged at 2000 g for 1 minute at 4° C. using a low brake and the supernatant was aspirated. The PBS wash cycle was repeated an additional 3 times. The bound protein was then eluted by adding 1 ml of 100 mM glycine pH 3.0 and gently agitating for 5 min at room temperature. The slurry was then centrifuged at 2000 g for 1 minute at 4° C. using a low brake and the supernatant was aspirated as the first elution. The elution cycle was repeated 2 more times, and all 3 supernatants were combined into a single pool. Sodium acetate (37.5 μl of a 3 M solution) was added to the elution pool to raise the pH, which was then dialyzed against 10 mM acetic acid, 5% sorbitol, pH 5.0 for 2 hours at room temperature using a 10 kDa SlideAlyzer (Pierce). The dialysis buffer was changed, and the dialysis continued over night at 4° C. The dialyzed material was then filtered through a 0.22 μm cellulose acetate filter syringe filter. Then concentration of the filtered material was determined to be 1.27 mg/ml using a calculated molecular mass of 30,330 and extinction coefficient of 35,410 $M^{-1}$ $cm^{-1}$ (FIG. 50A). The purity of the filtered material was then assessed using a Coomassie brilliant blue stained tris-glycine 4-20% SDS-PAGE (FIG. 50B). The endotoxin level was then determined using a Charles River Laboratories Endosafe-PTS system (0.05-5 EU/ml sensitivity) using a 25-fold dilution of the sample in Charles Rivers Laboratories Endotoxin Specific Buffer yielding a result of <1 EU/mg protein. The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 50C). The product was then subject to mass spectral analysis by diluting 1 μl of the sample into 10 μl of sinapinic acid (10 mg per ml in 0.05% trifluoroacetic acid, 50% acetonitrile). One milliliter of the resultant solution was spotted onto a MALDI sample plate. The sample was allowed to dry before being analyzed using a Voyager DE-RP time-of-flight mass spectrometer equipped with a nitrogen laser (337 nm, 3 ns pulse). The positive ion/linear mode was used, with an accelerating voltage of 25 kV. Each spectrum was produced by accumulating data from ~200 laser shots. External mass calibration was accomplished using purified proteins of known molecular masses. (FIG. 50D). The product was then stored at −80° C.

FIGS. 51A-D show results from the purification and analysis for Fc-L10-OsK1(E16K, K20D), which was conducted using the same protocol as that for the Fc-L110-OsK1 (K7S) molecule (described above) with the following exceptions: the concentration was found to be 1.59 mg/ml using a calculated molecular mass of 30,357 g/mol and a calculated extinction coefficient of 35,410; the pyrogen level was found to be <1 EU/mg using a 32-fold dilution.

FIGS. 52A-D show results from the purification and analysis for Fc-L10-OsK1(K7S,E16K, K20D), which was conducted using the same protocol as that for the Fc-L10-OsK1 (K7S) molecule (described above) with the following exceptions: the concentration was found to be 0.81 mg/ml using a calculated molecular mass of 30,316 g/mol and a calculated extinction coefficient of 35,410; the pyrogen level was found to be <1 EU/mg using a 16-fold dilution.

The activity of purified Fc-L10-OSK1[K7S], Fc-L10-OSK1[E16K, K20D] and Fc-L10-OSK1[K7S, E16K, K20D] in blocking human Kv1.3 and human Kv1.1 is described in Example 43 herein below.

Example 43

Electrophysiology of OSK1 and OSK1 Peptibody Analogs

A 38-residue peptide toxin of the Asian scorpion *Orthochirus scrobiculosus* venom (OSK1) was synthesized (see, Examples 41) to evaluate its impact on the human Kv1.1 and Kv1.3 channels, subtypes of the potassium channel family. The potency and selectivity of synthetic OSK1 in inhibiting the human Kv1.1 and Kv1.3 channels was evaluated by the use of HEK293 cell expression system and electrophysiology (FIG. 53). Whole cell patch clamp recording of stably expressed Kv1.3 channels revealed that the synthetic OSK1 peptide is more potent in inhibiting human Kv1.3 when compared to Kv1.1 (Table 33).

Fusion of OSK1 peptide toxin to antibody to generate OSK1 peptibody. To improve plasma half-life and prevent OSK1 peptide toxin from penetrating the CNS, the OSK1 peptide toxin was fused to the Fc-fragment of a human antibody IgG1 via a linker chain length of 10 amino acid residues (Fc-L10-OSK1), as described in Example 41 herein. This fusion resulted in a decrease in the potency of Kv1.3 by 5-fold when compared to the synthetic OSK1 peptide. However, it significantly improved the selectivity of OSK1 against Kv1.1 by 210-fold when compared to that of the synthetic peptide alone (4-fold; Table 33 and FIG. 54).

Modification of OSK1-peptibody (Fc-L10-OSK1). OSK1 shares 60 to 80% sequence homology to other members of scorpion toxins, which are collectively termed α-KTx3. Sequence alignment of OSK1 and other members of α-KTx3 family revealed 4 distinct structural differences at positions 12, 16, 20, and 36. These structural differences of OSK1 have been postulated to play an important role in its wide range of activities against other potassium channels, which is not observed with other members of α-KTx3 family. Hence, two amino acid residues at position 16 and 20 were restored to the more conserved amino acid residues within the OSK1 sequence in order to evaluate their impact on selectivity against other potassium channels such as Kv1.1, which is predominantly found in the CNS as a heterotetromer with Kv1.2. By substituting for glutamic acid at position 16, and for lysine at position 20, the conserved lysine and aspartic acid residues, respectively (i.e., Fc-L10-OSK1[E16K, K20D]), we did not observe a significant change in potency when compared to that of Fc-L10-OSK1 (1.3-fold difference; FIG. 56 and Table 33). However, this double mutation removed the blocking activity against Kv1.1. The selectivity ratio of Kv1.1/Kv1.3 was 403-fold, which was a significant improvement over the selectivity ratio for Fc-L10-OSK1 (210-fold). A single amino acid mutation at position 7 from lysine to serine (Fc-L10-OSK1[K7S]) produced a slight change in potency and selectivity by 2- and 1.3-fold, respectively, when compared to those of Fc-L10-OSK1 (FIG. 55 and Table 33). There was a significant decrease in potency as well as selectivity when all three residues were mutated to generate Fc-L10-OSK1[K7S, E16K, K20D] (FIG. 57 and Table 33).

As demonstrated by the results in Table 33, we dramatically improved selectivity against Kv1.1 by fusing the OSK1 peptide toxin to the Fc-fragment of the human antibody IgG1, but reduced target potency against Kv1.3. The selectivity against Kv1.1 was further improved when 2 residues at two key positions were restored to the conserved residues found in other members of the α-KTx3 family.

Table 33 shows a summary of IC50 values for OSK1 and OSK1 analogs against hKv1.3 and hKv1.1 channels. All analogues are ranked based on their potency against hKv1.3. Also shown in the table is the selectively ratio of hKv1.1/hKv1.3 for all OSK1 analogs.

| Compound | hKv1.3: $IC_{50}$ [pM] | hKv1.1: $IC_{50}$ [pM] | hKv1.1/ hKv1.3 |
|---|---|---|---|
| Synthetic OSK1 | 39 | 160 | 4 |
| Fc-L10-OSK1 | 198 | 41600 | 210 |
| Fc-L10-OSK1[E16K, K20D] | 248 | 100000 | 403 |
| Fc-L10-OSK1[K7S] | 372 | 100000 | 269 |
| Fc-L10-OSK1[K7S, E16K, K20D] | 812 | 10000 | 12 |

Example 44

Pharmacokinetic Study of PEG-ShK[1-35] Molecule in Rats

The intravenous (IV) pharmacokinetic profile was determined of a about 24-kDa 20K PEG-ShK[1-35] molecule and the about 4-kDa small native ShK peptide was determined in Spraque Dawley rats. The IV dose for the native ShK peptide and our novel 20K PEG-ShK[1-35] molecule was 1 mg/kg. This dose represented equal molar amounts of these two molecules. The average weight of the rats was about 0.3 kg and two rats were used for each dose & molecule. At various times following IV injection, blood was drawn and about 0.1 ml of serum was collected. Serum samples were stored frozen at −80° C. until analysis.

Assay Plate preparation for electrophysiology. Rat serum samples containing the 20K PEG-ShK[1-35] molecule or the native ShK peptide from pharmacokinetic studies were received frozen. Before experiments, each sample was thawed at room temperature and an aliquot (70 to 80 μl) was transferred to a well in a 96-well polypropylene plate. In order to prepare the Assay Plate, several dilutions were made from the pharmacokinetic serum samples to give rise to Test Solutions. Dilutions of serum samples from the pharmacokinetic study were into 10% Phosphate Buffered Saline (PBS, with $Ca^{2+}$ and $Mg^{2+}$). For determination of the amount of our novel 20K PEG-ShK[1-35] molecule in serum samples from the pharmacokinetic study, the final serum concentrations in the Test Solutions were 90%, 30%, 10%, 3.3% and 1.1%. Purified 20K PEG-Shk[1-35] Standard inhibition curves were also prepared in the Assay Plate. To do this, 8-point serial dilutions of the purified 20K PEG-ShK[1-35] molecule (Standard) were prepared in either 90%, 30%, 10%, 3.3% or 1.1% rat serum and the final concentration of standard was 50, 16.7, 5.5, 1.85, 0.62, 0.21, 0.068 and 0.023 nM.

Cell preparation for electrophysiology. CHO cells stably expressing the voltage-activated $K^+$ channel, $K_V1.3$ were plated in T-175 tissue culture flasks (at a density of $5\times10^6$) 2 days before experimentation and allowed to grow to around 95% confluence. Immediately prior to the experiment, the cells were washed with PBS and then detached with a 2 ml mixture (1:1 volume ratio) of trypsin (0.25%) and versene (1:5000) at 37° C. (for 3 minutes). Subsequently, the cells were re-suspended in the flask in 10 ml of tissue culture medium (HAM's F-12 with Glutamax, Invitrogen, Cat#31765) with 10% FBS, 1×NEAA and 750 μg/ml of G418) and centrifuged at about 1000 rpm for 1½ minutes. The resultant cell pellet was re-suspended in PBS at $3\text{-}5\times10^6$ cells/ml.

IonWorks electrophysiology and data analysis. The ability of Test solutions or Standards in serum to inhibit $K^+$ currents in the CHO-Kv1.3 cells was investigated using the automated electrophysiology system, IonWorks Quattro. Re-suspended cells, the Assay Plate, a Population Patch Clamp (PPC) PatchPlate as well as appropriate intracellular (90 mMK-Gluconate, 20 mMKF, 2 mM NaCl, 1 mM MgCl2, 10 mM EGTA, 10 mM HEPES, pH 7.35) and extracellular (PBS, with $Ca^{2+}$ and $Mg^{2+}$) buffers were positioned on IonWorks Quattro. Electrophysiology recordings were made from the CHO-Kv1.3 cells using an amphotericin-based perforated patch-clamp method. Using the voltage-clamp circuitry of the IonWorks Quattro, cells were held at a membrane potential of −80 mV and voltage-activated $K^+$ currents were evoked by stepping the membrane potential to +30 mV for 400 ms. $K^+$ currents were evoked under control conditions i.e., in the absence of inhibitor at the beginning of the experiment and after 10-minute incubation in the presence of the Test Solution or Standard. The mean $K^+$ current amplitude was measured between 430 and 440 ms and the data were exported to a Microsoft Excel spreadsheet. The amplitude of the $K^+$ current in the presence of each concentration of the Test Solution or Standard was expressed as a percentage of the $K^+$ current in control conditions in the same well.

Standard inhibition curves were generated for each standard in various levels of rat serum and expressed as current percent of control (POC) versus log of nM concentration. Percent of control (POC) is inversely related to inhibition, where 100 POC is no inhibition and 0 POC is 100% inhibition. Linear regression over a selected region of the curve was used to derive an equation to enable calculation of drug concentrations within Test solutions. Only current values within the linear portion of the Standard curve were used to calculate the concentration of drug in Test solutions. The corresponding Standard curve in a given level of serum, was always compared to the same level of serum of Test solution when calculating drug level. The Standard curves for ShK and 20K PEG-ShK[1-35] are shown in FIG. 58A and FIG. 58B, respectively, and each figure contains linear regression equations for each Standard at a given percentage of serum. For the 20K PEG-ShK[1-35] standard curve the linear portion of the Standard curve was from 20 POC to 70 POC and only current values derived from the Test solution which fell within this range were used to calculate drug concentration within the Test solution.

The pharmacokinetic profile of our novel 20K PEG ShK [1-35] molecule after IV injection is shown in FIG. 59. The terminal half-life ($t_{1/2}$ b) of this molecule is estimated from this curve to be between 6 to 12 hours long. Beyond 48 hours, the level of drug falls outside the linear range of the Standard curve and is not calculated. The calculated 6 to 12 hour half-life of our novel 20K PEG-ShK[1-35] molecule was substantially longer than the approximately 0.33 hour (or 20 min) half-life of the native ShK molecule reported earlier by C. Beeton et al. [C. Beeton et al. (2001) Proc. Natl. Acad. Sci. 98, 13942-13947], and is a desirable feature of a therapeutic molecule. A comparison of the relative levels of Kv1.3 inhibitor after an equal molar IV injection of ShK versus 20K PEG-ShK[1-35] is shown in FIG. 60. As can be seen from this figure examining 5% serum Test solutions, the 20K PEG-ShK [1-35] molecule showed significant suppression of Kv1.3 current (<70 POC) for more than 24 hours, whereas the native ShK peptide only showed a significant level of inhibition of Kv1.3 current for the first hour and beyond 1 hour showed no significant blockade. These data again demonstrate a desirable feature of the 20K PEG ShK[1-35] molecule as a therapeutic for treatment of autoimmune disease.

Example 45

PEGylated Toxin Peptide Suppressed Severe Autoimmune Encephalomyelitis in Animal Model The 20KPEG-ShK inhibitor of Kv1.3 shows improved efficacy in suppressing severe autoimmune encephalomyelitis in rats. Using an adoptive transfer experimental autoimmune encephalomyelitis (AT-EAE) model of multiple sclerosis described earlier [C. Beeton et al. (2001) J. Immunol. 166, 936], we examined the activity in vivo of our novel 20KPEG-ShK molecule and compared its efficacy to that of the ShK toxin peptide alone. The study design is illustrated in FIG. 61. The results from this in vivo study are provided in FIG. 62 and FIG. 63. The 20KPEG-ShK molecule delivered subcutaneously (SC) at 10 μg/kg daily from day −1 to day 3 significantly reduced disease severity and increased survival, whereas animals treated with an equal molar dose (10 μg/kg) of the small ShK peptide developed severe disease and died.

The 35-amino acid toxin peptide ShK (*Stichodactyla helianthus* neurotoxin) was purchased from Bachem Bioscience Inc and confirmed by electrophysiology to potently block Kv1.3 (see Example 36 herein). The synthesis, PEGylation and purification of the 20KPEG ShK molecule was as described herein above. The encephalomyelogenic CD4+ rat T cell line, PAS, specific for myelin-basic protein (MBP) originated from Dr. Evelyne Beraud. The maintenance of these cells in vitro and their use in the AT-EAE model has been described earlier [C. Beeton et al. (2001) PNAS 98, 13942]. PAS T cells were maintained in vitro by alternating rounds of antigen stimulation or activation with MBP and irradiated thymocytes (2 days), and propagation with T cell growth factors (5 days). Activation of PAS T cells ($3\times10^5$/ml) involved incubating the cells for 2 days with 10 μg/ml MBP and $15\times10^6$/ml syngeneic irradiated (3500 rad) thymocytes. On day 2 after in vitro activation, $10\text{-}15\times10^6$ viable PAS T cells were injected into 6-12 week old female Lewis rats (Charles River Laboratories) by tail IV. Daily subcutaneous injections of vehicle (2% Lewis rat serum in PBS), 20KPEG-ShK or ShK were given from days −1 to 3 (FIG. 61), where day −1 represent 1 day prior to injection of PAS T cells (day 0). In vehicle treated rats, acute EAE developed 4 to 5 days after injection of PAS T cells (FIG. 62). Serum was collected by retro-orbital bleeding at day 4 and by cardiac puncture at day 8 (end of the study) for analysis of levels of inhibitor. Rats were weighed on days −1, 4, 6, and 8. Animals were scored blinded once a day from the day of cell transfer (day 0) to day 3, and twice a day from day 4 to day 8. Clinical signs were evaluated as the total score of the degree of paresis of each limb and tail. Clinical scoring: 0=No signs, 0.5=distal limp tail, 1.0=limp tail, 2.0=mild paraparesis, ataxia, 3.0=moderate paraparesis, 3.5=one hind leg paralysis, 4.0=complete hind leg paralysis, 5.0=complete hind leg paralysis and incontinence, 5.5=tetraplegia, 6.0=moribund state or death. Rats reaching a score of 5.5 were euthanized.

Treatment of rats with the Kv1.3 blocker PEG-ShK prior to the onset of EAE caused a lag in the onset of disease, inhibited the progression of disease, and prevented death in a dose-dependent manner (FIG. 62). Onset of disease in rats that were treated with the vehicle alone, 10 μg/kg ShK or 1 μg/kg of PEG-ShK was observed on day 4, compared to day 4.5 in rats treated with 10 μg/kg PEG-ShK or 100 μg/kg PEG-ShK. In addition, rats treated with vehicle alone, 10 μg/kg ShK or 1 μg/kg of PEG-ShK all developed severe disease by the end of the study with an EAE score of 5.5 or above. In contrast, rats treated with 10 μg/kg PEG-ShK or 100 μg/kg PEG-ShK, reached a peak clinical severity score average of <2, and all but one rat survived to the end of the study. Furthermore, we found that rat body weight correlated with disease severity (FIG. 63). Rats treated with vehicle alone, 10 μg/kg ShK or 1 μg/kg of PEG-ShK all lost an average of 31 g, 30 g, and 30 g, respectively, while rats treated with 10 μg/kg PEG-ShK or 100 μg/kg PEG-ShK lost 18 g and 11 g, respectively. Rats in the latter two groups also appeared to be gaining weight by the end of the study, a sign of recovery. It should be noted that rats treated with 10 μg/kg ShK and 10 μg/kg PEG-ShK received molar equivalents of the ShK peptide. The significantly greater efficacy of the PEG-ShK molecule relative to unconjugated ShK, is likely due to the PEG-ShK molecule's greater stability and prolonged half-life in vivo (see, Example 44).

Example 46

Compositions Including Kv1.3 Antagonist Peptides Block Inflammation in Human Whole Blood Ex vivo assay to examine impact of Kv1.3 inhibitors on secretion of IL-2 and IFN-g. Human whole blood was obtained from healthy, non-medicated donors in a heparin vacutainer. DMEM complete media was Iscoves DMEM (with L-glutamine and 25 mM Hepes buffer) containing 0.1% human albumin (Bayer #68471), 55 μM 2-mercaptoethanol (Gibco), and 1× Pen-Strep-Gln (PSG, Gibco, Cat#10378-016). Thapsigargin was obtained from Alomone Labs (Israel). A 10 mM stock solution of thapsigargin in 100% DMSO was diluted with DMEM complete media to a 40 μM, 4× solution to provide the 4× thapsigargin stimulus for calcium mobilization. The Kv1.3 inhibitor peptide ShK (*Stichodacytla helianthus* toxin, Cat# H2358) and the BKCa1 inhibitor peptide IbTx (Iberiotoxin, Cat# H9940) were purchased from Bachem Biosciences, whereas the Kv1.1 inhibitor peptide DTX-k (Dendrotoxin-K) was from Alomone Labs (Israel). The CHO-derived Fc-L10-ShK[2-35] peptibody inhibitor of Kv1.3 was obtained as described herein at Example 4 and Example 39. The calcineurin inhibitor cyclosporin A was obtained from the Amgen sample bank, but is also available commercially from a variety of vendors. Ten 3-fold serial dilutions of inhibitors were prepared in DMEM complete media at 4× final concentration and 50 μl of each were added to wells of a 96-well Falcon 3075 flat-bottom microtiter plate. Whereas columns 1-5 and 7-11 of the microtiter plate contained inhibitors (each row with a separate inhibitor dilution series), 50 μl of DMEM complete media alone was added to the 8 wells in column 6 and 100 μl of DMEM complete media alone was added to the 8 wells in column 12. To initiate the experiment, 100 μl of whole blood was added to each well of the microtiter plate. The plate was then incubated at 37° C., 5% $CO_2$ for one hour. After one hour, the plate was removed and 50 μl of the 4× thapsigargin stimulus (40 μM) was added to all wells of the plate, except the 8 wells in column 12. The plates were placed back at 37° C., 5% $CO_2$ for 48 hours. To determine the amount of IL-2 and IFN-g secreted in whole blood, 100 μl of the supernatant (conditioned media) from each well of the 96-well plate was transferred to a storage plate. For MSD electrochemilluminesence analysis of cytokine production, 20 μl of the supernatants (conditioned media) were added to MSD Multi-Spot Custom Coated plates (meso-scale.com). The working electrodes on these plates were coated with four Capture Antibodies (hIL-5, hIL-2, hIFNg and hIL-4) in advance. After addition of 20 μl of conditioned media to the MSD plate, 150 μl of a cocktail of Detection Antibodies and P4 Buffer were added to each well. The 150 μl cocktail contained 20 ul of four Detection Antibodies (hIL-5, hIL-2, hIFNg and hIL-4) at 1 μg/ml each and 130 ul of 2×P4 Buffer. The plates were covered and placed on a shaking platform overnight (in the dark). The next morning the plates were read on the MSD Sector Imager. Since the 8 wells in column 6 of each plate received only the thapsigargin stimulus and no inhibitor, the average MSD response here was used to calculate the "High" value for a plate. The calculate "Low" value for the plate was derived from the average MSD response from the 8 wells in column 12 which contained no thapsigargin stimulus and no inhibitor. Percent of control (POC) is a measure of the response relative to the unstimulated versus stimulated controls, where 100 POC is equivalent to the average response of thapsigargin stimulus alone or the "High" value. Therefore, 100 POC represents 0% inhibition of the response. In contrast, 0 POC represents 100% inhibition of the response and would be equivalent to the response where no stimulus is given or the "Low" value. To calculate percent of control (POC), the following formula is used: [(MSD response of well)−("Low")]/[("High")−("Low")]×100. The potency of the molecules in whole blood was calculated after curve fitting from the inhibition curve (IC) and IC50 was derived using standard curve fitting software. Although we describe here measurement of cytokine production using a high throughput MSD electrochemillumenescence assay, one of skill in the art can readily envision lower throughput ELISA assays are equally applicable for measuring cytokine production.

Ex vivo assay demonstrating Kv1.3 inhibitors block cell surface activation of CD40L & IL-2R. Human whole blood was obtained from healthy, non-medicated donors in a heparin vacutainer. DMEM complete media was Iscoves DMEM (with L-glutamine and 25 mM Hepes buffer) containing 0.1% human albumin (Bayer #68471), 55 μM 2-mercaptoethanol (Gibco), and 1× Pen-Strep-Gln (PSG, Gibco, Cat#10378-016). Thapsigargin was obtained from Alomone Labs (Israel). A 10 mM stock solution of thapsigargin in 100% DMSO was diluted with DMEM complete media to a 40 μM, 4× solution to provide the 4× thapsigargin stimulus for calcium mobilization. The Kv1.3 inhibitor peptide ShK (*Stichodacytla helianthus* toxin, Cat# H2358) and the BKCa1 inhibitor peptide IbTx (Iberiotoxin, Cat# H9940) were purchased from Bachem Biosciences, whereas the Kv1.1 inhibitor peptide DTX-k (Dendrotoxin-K) was from Alomone Labs (Israel). The CHO-derived Fc-L110-ShK[2-35] peptibody inhibitor of Kv1.3 was obtained as described in Example 4 and Example 39. The calcineurin inhibitor cyclosporin A was obtained from the Amgen sample bank, but is also available commercially from a variety of vendors. The ion channel inhibitors ShK, IbTx or DTK-k were diluted into DMEM complete media to 4× of the final concentration desired (final=50 or 100 nM). The calcineurin inhibitor cyclosporin A was also diluted into DMEM complete media to 4× final concentration (final=10 μM). To appropriate wells of a 96-well Falcon 3075 flat-bottom microtiter plate, 50 μl of either DMEM complete media or the 4× inhibitor solutions were added. Then, 100 μl of human whole blood was added and the plate was incubated for 1 hour at 37° C., 5% $CO_2$. After one hour, the plate was removed and 50 μl of the 4× thapsigargin stimulus (40 μM) was added to all wells of the plate containing inhibitor. To some wells containing no inhibitor but just DMEM complete media, thapsigargin was also added whereas others wells with just DMEM complete media had an additional 50 μl of DMEM complete media added. The wells with no inhibitor and no thapsigargin stimulus represented the untreated "Low" control. The wells with no inhibitor but which received thapsigargin stimulus represented the control for maximum stimulation or "High" control. Plates were placed back at 37° C., 5% $CO_2$ for 24 hours. After 24 hours, plates were removed and wells were process for FACS analysis. Cells were removed from the wells and washed in staining buffer (phosphate buffered saline containing 2% heat-inactivated fetal calf serum). Red blood cells were lysed using BD FACS Lysing Solution containing 1.5% formaldehyde (BD Biosciences) as directed by the manufacturer. Cells were distributed at a concentration of 1 million cells per 100 microliters of staining buffer per tube. Cells were first stained with 1 microliter of biotin-labeled anti-human CD4, washed, then stained simultaneously 1 microliter each of streptavidin-APC, FITC-labeled anti-human CD45RA, and phycoerythrin (PE)-labeled anti-human CD25 (IL-2Ra) or PE-labeled anti-human CD40L. Cells were washed with staining buffer between antibody addition steps. All antibodies were obtained from BD Biosciences (San Diego, Calif.). Twenty to fifty thousand live events were collected for each sample on a Becton Dickinson FACSCaliber (Mountain View, Calif.) flow cytometer and analyzed using FlowJo software (Tree Star Inc., San Carlos, Calif.). Dead cells, monocytes, and granulocytes were excluded from the analysis on the basis of forward and side scatter properties.

FIG. 64 and FIG. 67 demonstrate that Kv1.3 inhibitors ShK and Fc-L10-ShK[2-35] potently blocked IL-2 secretion in human whole blood, in addition to suppressing activation of the IL-2R on CD4+ T cells. The Kv1.3 inhibitor Fc-L10-ShK [2-35] was more than 200 times more potent in blocking IL-2 production in human whole blood than cyclosporine A (FIG. 64) as reflected by the IC50. FIG. 65 shows that Kv1.3 inhibitors also potently blocked secretion of IFNg in human whole blood, and FIG. 66 demonstrates that upregulation of CD40L on T cells was additionally blocked. The data in FIGS. 64-67 show that the Fc-L10-ShK[2-35] molecule was stable in whole blood at 37° C. for up to 48 hours, providing potent blockade of inflammatory responses. Toxin peptide therapeutic agents that target Kv1.3 and have prolonged half-life, are sought to provide sustained blockade of these responses in vivo over time. In contrast, despite the fact the Kv1.3 inhibitor peptide ShK also showed potent blockade in whole blood, the ShK peptide has a short (~20 min) half-life in vivo (C. Beeton et al. (2001) Proc. Natl. Acad. Sci. 98, 13942), and cannot, therefore, provide prolonged blockade. Whole blood represents a physiologically relevant assay to predict the response in animals. The whole blood assays described here can also be used as a pharmacodynamic (PD) assay to measure target coverage and drug exposure following dosing of patients. These human whole blood data support the therapeutic usefulness of the compositions of the present invention for treatment of a variety immune disorders, such as multiple sclerosis, type 1 diabetes, psoriasis, inflammatory bowel disease, contact-mediated dermatitis, rheumatoid arthritis, psoriatic arthritis, asthma, allergy, restinosis, systemic sclerosis, fibrosis, scleroderma, glomerulonephritis, Sjogren syndrome, inflammatory bone resorption, transplant rejection, graft-versus-host disease, and lupus.

Example 47

PEGylated Peptibodies

By way of example, PEGylated peptibodies of the present invention were made by the following method. CHO-expressed FcL10-OsK1 (19.2 mg; MW 30,371 Da, 0.63 micromole) in 19.2 ml A5S, 20 mM $NaBH_3CN$, pH 5, was treated with 38 mg PEG aldehyde (MW 20 kDa; 3×, Lot 104086). The sealed reaction mixture was stirred in a cold room overnight. The extent of the protein modification during the course of the reaction was monitored by SEC HPLC using a Superose 6 HR 10/30 column (Amersham Pharmacia Biotech) eluted with a 0.05 M phosphate buffer, 0.5 M NaCl, pH 7.0 at 0.4 ml/min. The reaction mixture was dialyzed with A5S, pH 5 overnight. The dialyzed material was then loaded onto an SP HP FPLC column (16/10) in A5S pH 5 and eluted with a 1 M NaCl gradient. The collected fractions were analyzed by SEC HPLC, pooled into 3 pools, exchanged into DPBS, concentrated and submitted for functional testing (Table 34).

In another example, FcL10-ShK1 (16.5 mg; MW 30,065 Da, 0.55 micro mole) in 16.5 ml A5S, 20 mM $NaBH_3CN$, pH 5 was treated with 44 mg PEG aldehyde (MW 20 kDa; 4×, Lot 104086). The sealed reaction mixture was stirred in a cold room overnight. The extent of the protein modification during the course of the reaction was monitored by SEC HPLC using a Superose 6 HR 10/30 column (Amersham Pharmacia Biotech) eluted with a 0.05 M phosphate buffer, 0.5 M NaCl, pH 7.0 at 0.4 ml/min. The reaction mixture was dialyzed with A5S, pH 5 overnight. The dialyzed material was loaded onto an SP HP FPLC column (16/10) in A5S pH 5 and was eluted with a 1 M NaCl gradient. The collected fractions were analyzed by SEC HPLC, pooled into 3 pools, exchanged into DPBS, concentrated and submitted for functional testing (Table 34).

The data in Table 34 demonstrate potency of the PEGylated peptibody molecules as Kv1.3 inhibitors.

Table 34 shows determination of IC50 made by whole cell patch clamp electrophysiology with HEK 293 as described in Example 36 herein above. The sustained IC50 was derived from the current 400 msecs after voltage ramp from −80 mV to +30 mV. Pool #2 samples comprised di-PEGylated peptibodies and Pool #3 samples comprised mono-PEGylated peptibodies.

| PEGylated Peptibody | Pool # | IC50 Sustained (nM) |
|---|---|---|
| PEG-Fc-L10-SHK (2-35) | 3 | 0.175 (n = 4) |
| PEG-Fc-L10-SHK (2-35) | 2 | 0.158 (n = 4) |
| PEG-Fc-L10-OSK1 | 3 | 0.256 (n = 3) |
| PEG-Fc-L10-OSK1 | 2 | 0.332 (n = 3) |

Example 48

PEGylated Toxin Peptides

Shk and Osk-1 PEGylation, purification and analysis. Synthetic Shk or OSK1-1 toxin peptides were selectively PEGylated by reductive alkylation at their N-termini. Conjugation was achieved, with either Shk or OSK-1 toxin peptides, at 2 mg/ml in 50 mM $NaH_2PO_4$, pH 4.5 reaction buffer containing 20 mM sodium cyanoborohydride and a 2 molar excess of 20 kDa monomethoxy-PEG-aldehyde (Nektar Therapeutics, Huntsville, Ala.). Conjugation reactions were stirred overnight at room temperature, and their progress was monitored by RP-HPLC. Completed reactions were quenched by 4-fold dilution with 20 mM NaOAc, pH 4, adjusted to pH 3.5 and chilled to 4° C. The PEG-peptides were then purified chromatographically at 4° C.; using SP Sepharose HP columns (GE Healthcare, Piscataway, N.J.) eluted with linear 0-1M NaCl gradients in 20 mM NaOAc, pH 4.0. (FIG. 68A and FIG. 68B) Eluted peak fractions were analyzed by SDS-PAGE and RP-HPLC and pooling determined by purity >97%. Principle contaminants observed were di-PEGylated toxin peptide and unmodified toxin peptide. Selected pools were concentrated to 2-5 mg/ml by centrifugal filtration against 3 kDa MWCO membranes and dialyzed into 10 mM NaOAc, pH 4 with 5% sorbitol. Dialyzed pools were then sterile filtered through 0.2 micron filters and purity determined to be >97% by SDS-PAGE and RP-HPLC (FIG. 69A and FIG. 69B). Reverse-phase HPLC was performed on an Agilent 1100 model HPLC running a Zorbax 5 μm 300SB-C8 4.6×50 mm column (Phenomenex) in 0.1% TFA/$H_20$ at 1 ml/min and column temperature maintained at 40° C. Samples of PEG-peptide (20 μg) were injected and eluted in a linear 6-60% gradient while monitoring wavelengths 215 nm and 280 nm.

Electrophysiology performed by patch clamp on whole cells (see, Example 36) yielded a peak IC50 of 1.285 nM for PEG-OSK1 and 0.169 nM for PEG-ShK[1-35] (FIG. 74), in a concentration dependent block of the outward potassium current recorded from HEK293 cells stably expressing human Kv1.3 channel. The purified PEG-ShK[1-35] molecule, also referred to as "20K PEG-ShK[1-35]" and "PEG-ShK", had a much longer half-life in vivo than the small ShK peptide (FIG. 59 and FIG. 60). PEG-ShK[1-35] suppressed severe autoimmune encephalomyelitis in rats (Example 45, FIGS. 61-63) and showed greater efficacy than the small native ShK peptide.

PEG conjugates of OSK1 peptide analogs were also generated and tested for activity in blocking T cell inflammation in the human whole blood assay (Example 46). As shown in Table 43, OSK1[Ala12], OSK1[Ala29], OSK1[Nal34] and OSK1[Ala29, 1Nal34] analogs containing an N-terminal 20K PEG conjugate, all provided potent blockade of the whole blood cytokine response in this assay. The 20K PEG-ShK was also highly active (Table 43).

Example 49

Fc Loop Insertions of ShK and OSK1 Toxin Peptides

As exemplified in FIG. 70, FIG. 71, FIG. 72, and FIG. 73, disulphide-constrained toxin peptides were inserted into the human IgG1 Fc-loop domain, defined as the sequence $D_{137}E_{138}T_{139}T_{140}K_{141}$, according to the method published in Example 1 in Gegg et al., Modified Fc molecules, WO 2006/036834 A2 [PCT/US2005/034273]). Exemplary FcLoop-L2-OsK1-L2, FcLoop-L2-ShK-L2, FcLoop-L2-ShK-L4, and FcLoop-L4-OsK1-L2 were made having three linked domains. These were collected, purified and submitted for functional testing.

The peptide insertion for these examples was between Fc residues $Leu_{139}$ and $Thr_{140}$ and included 2-4 Gly residues as linkers flanking either side of the inserted peptide. However, alternate insertion sites for the human IgG1 Fc sequence, or different linkers, are also useful in the practice of the present invention, as is known in the art, e.g., as described in Example 13 of Gegg et al., Modified Fc molecules, WO 2006/036834 A2 [PCT/US2005/034273]).

Purified FcLoop OSK1 and FcLoop ShK1 molecules were tested in the whole blood assay of inflammation (see, Example 46). FcLoop-L2-OsK1-L2, FcLoop-L4-OsK1-L4 and FcLoop-L2-ShK-L2 toxin conjugates all provided potent blockade of the whole blood cytokine response in this assay, with IC50 values in the pM range (Table 43).

Example 50

Purification of ShK(2-35)-L-Fc from *E. coli*

Frozen, *E. coli* paste (117 g), obtained as described in Example 16 herein above, was combined with 1200 ml of room temperature 50 mM tris HCl, 5 mM EDTA, pH 7.5 and was brought to about 0.1 mg/ml hen egg white lysozyme. The suspended paste was passed through a chilled microfluidizer twice at 12,000 PSI. The cell lysate was then centrifuged at 17,700 g for 30 min at 4° C. The pellet was then resuspended in 1200 ml 1% deoxycholic acid using a tissue grinder and then centrifuged at 17,700 g for 30 min at 4° C. The pellet was then resuspended in 1200 ml water using a tissue grinder and then centrifuged at 17,700 g for 30 min at 4° C. 6.4 g of the pellet (total 14.2 g) was then dissolved in 128 ml 8 M guanidine HCl, 50 mM tris HCl, pH 8.0. 120 ml of the pellet solution was then incubated with 0.67 ml of 1 M DTT for 60 min at 37° C. The reduced material was transferred to 5500 ml of the refolding buffer (3 M urea, 50 mM tris, 160 mM arginine HCl, 2.5 mM EDTA, 2.5 mM cystamine HCl, 4 mM cysteine, pH 9.5) at 2 ml/min, 4° C. with vigorous stirring. The stirring rate was then slowed and the incubation was continued for 3 days at 4° C.

The refold was diluted with 5.5 L of water, and the pH was adjusted to 8.0 using acetic acid, then the solution was filtered through a 0.22 μm cellulose acetate filter and loaded on to a 35 ml Amersham Q Sepharose-FF (2.6 cm I.D.) column at 10 ml/min in Q-Buffer A (20 mM Tris, pH 8.5) at 8° C. with an inline 35 ml Amersham Mab Select column (2.6 cm I.D.). After loading, the Q Sepharose column was removed from the circuit, and the remaining chromatography was carried out on the Mab Select column. The column was washed with several column volumes of Q-Buffer A, followed by elution using a step to 100 mM glycine pH 3.0. The fractions containing the desired product immediately loaded on to a 5.0 ml Amersham SP-Sepharose HP column at 5.0 ml/min in S-Buffer A (10 mM $NaH_2PO_4$, pH 7.0) at 8° C. The column was then washed with several column volumes of S-Buffer A followed by a linear gradient from 5% to 60% S-Buffer B (10 mM $NaH_2PO_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled and then applied to a 50 ml MEP Hypercel column (2.6 cm I.D.) at 10 ml/min in MEP Buffer A (20 mM tris, 200 mM NaCl, pH 8.0) at 8° C. Column was eluted with a linear gradient from 5% to 50% MEP Buffer B (50 mM sodium citrate pH 4.0) followed by a step to 100% MEP Buffer B. Fractions were then analyzed using a Coomassie brilliant blue stained tris-glycine 4-20% SDS-PAGE, and the fractions containing the bulk of the desired product were pooled.

The MEP-pool was then concentrated to about 10 ml using a Pall Jumbo-Sep with a 10 kDa membrane. A spectral scan was then conducted on 50 μl of the combined pool diluted in 700 μl PBS using a Hewlett Packard 8453 spectrophotometer (FIG. 76A). Then concentration of the material was determined to be 3.7 mg/ml using a calculated molecular mass of 30,253 and extinction coefficient of 36,900 $M^{-1}$ $cm^{-1}$. The purity of the material was then assessed using a Coomassie brilliant blue stained tris-glycine 4-20% SDS-PAGE (FIG. 76B). The macromolecular state of the product was then determined using size exclusion chromatography on 70 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 76C). The product was then subject to mass spectral analysis by chromatographing approximately 4 μg of the sample through a RP-HPLC column (Vydac $C_4$, 1×150 mm). Solvent A was 0.1% trifluoroacetic acid in water and solvent B was 0.1% trifluoroacetic acid in 90% acetonitrile, 10% water. The column was pre-equilibrated in 10% solvent B at a flow rate of 80 μl per min. The protein was eluted using a linear gradient of 10% to 90% solvent B over 30 min. Part of the effluent was directed into a LCQ ion trap mass spectrometer. The mass spectrum was deconvoluted using the Bioworks software provided by the mass spectrometer manufacturer. (FIG. 76D). The product was filtered through a 0.22 μm cellulose acetate filter and then stored at −80° C.

In Table 35, IC50 data for the purified *E. coli*-derived ShK[2-35]-L-Fc are compared to some other embodiments of the inventive composition of matter.

TABLE 35

*E. coli*-derived recombinant Fc-L-ShK[1-35], Fc-L-ShK[2-35], Fc-L-OSK1, Shk[1-35]-L-Fc and ShK[2-35]-L-Fc peptibodies containing Fc at either the N-terminus or C-terminus show potent blockade of human Kv1.3. The activity of the CHO-derived Fc-L10-ShK[1-35] R1Q mutant is also shown. Whole cell patch clamp electrophysiology (WCVC), by methods described in Example 36, was performed using HEK293/Kv1.3 cells and the IC50 shown is the average from dose-response curves from 3 or more cells. IonWorks ™ (IWQ) planar patch clamp electrophysiology by methods described in Example 44 was on CHO/Kv1.3 cells and the average IC50 is shown. The inventive molecules were obtained by methods as described in the indicated Example: *E. coli*-derived Fc-L-ShK[1-35] (Example 3 and Example 38), *E. coli*-derived Fc-L-ShK[2-35] (Example 4 and Example 39), *E. coli* Fc-L-OSK1 (Example 10 and Example 40), ShK[1-35]-L-Fc (Example 15 and Example 51), and ShK[2-35]-L-Fc (Example 16 and this Example 50). CHO-derived Fc-L10-ShK[1-35] R1Q molecule was generated using methods similar to those described for CHO-derived Fc-L10-ShK[1-35].

| Molecule | Kv1.3 $IC_{50}$ by WCVC (nM) | Kv1.3 $IC_{50}$ by IWQ (nM) |
|---|---|---|
| *E. coli*-derived Fc-L-ShK[1-35] | 1.4 | |
| *E. coli*-derived Fc-L-ShK[2-35] | 1.3 | 2.8 |
| *E. coli*-derived Fc-L-OSK1 | 3.2 | |
| *E. coli*-derived Shk[1-35]-L-Fc | | 2.4 |
| *E. coli*-derived ShK[2-35]-L-Fc | | 4.9 |
| CHO-derived Fc-L10-ShK[1-35] R1Q | | 2.2 |

TABLE 35-continued

*E. coli*-derived recombinant Fc-L-ShK[1-35], Fc-L-ShK[2-35], Fc-L-OSK1, Shk[1-35]-L-Fc and ShK[2-35]-L-Fc peptibodies containing Fc at either the N-terminus or C-terminus show potent blockade of human Kv1.3. The activity of the CHO-derived Fc-L10-ShK[1-35] R1Q mutant is also shown. Whole cell patch clamp electrophysiology (WCVC), by methods described in Example 36, was performed using HEK293/Kv1.3 cells and the IC50 shown is the average from dose-response curves from 3 or more cells. IonWorks ™ (IWQ) planar patch clamp electrophysiology by methods described in Example 44 was on CHO/Kv1.3 cells and the average IC50 is shown. The inventive molecules were obtained by methods as described in the indicated Example: *E. coli*-derived Fc-L-ShK[1-35] (Example 3 and Example 38), *E. coli*-derived Fc-L-ShK[2-35] (Example 4 and Example 39), *E. coli* Fc-L-OSK1 (Example 10 and Example 40), ShK[1-35]-L-Fc (Example 15 and Example 51), and ShK[2-35]-L-Fc (Example 16 and this Example 50). CHO-derived Fc-L10-ShK[1-35] R1Q molecule was generated using methods similar to those described for CHO-derived Fc-L10-ShK[1-35].

Example 51

Purification of Met-ShK(1-35)-Fc from *E. coli*

Frozen, *E. coli* paste (65 g), obtained as described in Example 15 herein above was combined with 660 ml of room temperature 50 mM tris HCl, 5 mM EDTA, pH 7.5 and was brought to about 0.1 mg/ml hen egg white lysozyme. The suspended paste was passed through a chilled microfluidizer twice at 12,000 PSI. The cell lysate was then centrifuged at 17,700 g for 30 min at 4° C. The pellet was then resuspended in 660 ml 1% deoxycholic acid using a tissue grinder and then centrifuged at 17,700 g for 30 min at 4° C. The pellet was then resuspended in 660 ml water using a tissue grinder and then centrifuged at 17,700 g for 30 min at 4° C. 13 g of the pellet was then dissolved in 130 ml 8 M guanidine HCl, 50 mM tris HCl, pH 8.0. 10 ml of the pellet solution was then incubated with 0.1 ml of 1 M DTT for 60 min at 37° C. The reduced material was transferred to 1000 ml of the refolding buffer (2 M urea, 50 mM tris, 160 mM arginine HCl, 2.5 mM EDTA, 1.2 mM cystamine HCl, 4 mM cysteine, pH 8.5) at 2 ml/min, 4° C. with vigorous stirring. The stirring rate was then slowed and the incubation was continued for 3 days at 4° C.

The refold was diluted with 1 L of water, and filtered through a 0.22 μm cellulose acetate filter then loaded on to a 35 ml Amersham Q Sepharose-FF (2.6 cm I.D.) column at 10 ml/min in Q-Buffer A (20 mM Tris, pH 8.5) at 8° C. with an inline 35 ml Amersham Mab Select column (2.6 cm I.D.). After loading, the Q Sepharose column was removed from the circuit, and the remaining chromatography was carried out on the Mab Select column. The column was washed with several column volumes of Q-Buffer A, followed by elution using a step to 100 mM glycine pH 3.0. The fractions containing the desired product immediately loaded on to a 5.0 ml Amersham SP-Sepharose HP column at 5.0 ml/min in S-Buffer A (20 mM $NaH_2PO_4$, pH 7.0) at 8° C. The column was then washed with several column volumes of S-Buffer A followed by a linear gradient from 5% to 60% S-Buffer B (20 mM $NaH_2PO_4$, 1 M NaCl, pH 7.0) followed by a step to 100% S-Buffer B. Fractions were then analyzed using a Coomassie brilliant blue stained tris-glycine 4-20% SDS-PAGE. The fractions containing the bulk of the desired product were pooled.

The S-pool was then concentrated to about 10 ml using a Pall Jumbo-Sep with a 10 kDa membrane. A spectral scan was then conducted on 20 μl of the combined pool diluted in 700 μl PBS using a Hewlett Packard 8453 spectrophotometer (FIG. 77A). Then concentration of the material was determined to be 3.1 mg/ml using a calculated molecular mass of 30,409 and extinction coefficient of 36,900 $M^{-1}$ $cm^{-1}$. The purity of the material was then assessed using a Coomassie brilliant blue stained tris-glycine 4-20% SDS-PAGE (FIG. 77B). The macromolecular state of the product was then determined using size exclusion chromatography on 93 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 77C). The product was then subject to mass spectral analysis by MALDI mass spectrometry.

An aliquot of the sample was spotted with the MALDI matrix sinapinic acid on sample plate. A Voyager DE-RP time-of-flight mass spectrometer equipped with a nitrogen laser (337 nm, 3 ns pulse) was used to collect spectra. The positive ion/linear mode was used, with an accelerating voltage of 25 kV. Each spectrum was produced by accumulating data from ~200 laser shots (FIG. 77D). External mass calibration was accomplished using purified proteins of known molecular masses.

The IC50 for blockade of human Kv1.3 by purified *E. coli*-derived Met-ShK(1-35)-Fc, also referred to as "ShK[1-35]-L-Fc", is shown in Table 35 herein above.

Example 52

Bacterial Expression of OsK1-L-Fc Inhibitor of Kv1.3

The methods to clone and express the peptibody in bacteria were as described in Example 3. The vector used was pAMG21amgR-pep-Fc and the oligos listed below were used to generate a duplex (see below) for cloning and expression in bacteria of OsK1-L-Fc. Oligos used to form duplex are shown below:

```
                                             SEQ ID NO: 1347
GGGTGTTATCATCAACGTTAAATGCAAAATCTCCCGTCAGTGCCTGGAAC
CGTGCAAAAAAGCTGGTATGCGT //;

                                             SEQ ID NO: 1348
TTCGGTAAATGCATGAACGGTAAATGCCACTGCACCCCGAAATCTGGTGG
TGGTGCTTCT //;
```

-continued

```
                                             SEQ ID NO: 1349
CACCACAACCACCACCACCACCAGATTTCGGGGTGCAGTGGCATTTACCG
TTCATGCATTTACCGAAACGCAT //;

                                             SEQ ID NO: 1310
ACCAGCTTTTTTGCACGGTTCCAGGCACTGACGGGAGATTTTGCATTTAA
CGTTGATGATAAC //;
```

The oligos shown above were used to form the duplex shown below:

```
    GGGTGTTATCATCAACGTTAAATGCAAAATCTCCCGTCAGTGCCTGGAACCGTGCAAAAA      SEQ ID NO: 1350
  1 ---------+---------+---------+---------+---------+---------+  60
        CAATAGTAGTTGCAATTTACGTTTTAGAGGGCAGTCACGGACCTTGGCACGTTTTT      SEQ ID NO: 1352

     G  V  I  I  N  V  K  C  K  I  S  R  Q  C  L  E  P  C  K  K    - SEQ ID NO: 1351

    AGCTGGTATGCGTTTCGGTAAATGCATGAACGGTAAATGCCACTGCACCCCGAAATCTGG
 61 ---------+---------+---------+---------+---------+---------+  120
    TCGACCATACGCAAAGCCATTTACGTACTTGCCATTTACGGTGACGTGGGGCTTTAGACC

     A  G  M  R  F  G  K  C  M  N  G  K  C  H  C  T  P  K  S  G    -

    TGGTGGTGGTTCT //
121 ---------+-------                                              137
    ACCACCACCAAGACCAC //

     G  G  G  S  G //                                              -
```

Bacterial expression of the peptibody was as described in Example 3 and paste was stored frozen.

Example 53

Bacterial Expression of Gly-ShK(1-35)-L-Fc Inhibitor of Kv1.3

The methods to clone and express the peptibody in bacteria were as described in Example 3. The vector used was pAMG21amgR-pep-Fc and the oligos listed below were used to generate a duplex (see below) for cloning and expression in bacteria of Gly-ShK(1-35)-L-Fc. Oligos used to form duplex are shown below:

```
                                             SEQ ID NO: 1313
GGGTCGTTCTTGTATTGATACTATTCCAAAATCTCGTTGTACTGCTTTTC
AATGTAAACATTCTATGAAATATCGTCTTTCTT //;

                                             SEQ ID NO: 1314
TTTGTCGTAAAACTTGTGGTACTTGTTCTGGTGGTGGTGGTTCT //;

                                             SEQ ID NO: 1353
CACCAGAACCACCACCACCAGAACAAGTACCACAAGTTTTACGACAAAAA
GAAAGACGATATTTCATAGAATGTTTACATTGA //;

                                             SEQ ID NO: 1354
AAAGCAGTACAACGAGATTTTGGAATAGTATCAATACAAGAACG //;
```

The oligos shown above were used to form the duplex shown below:

```
     GGGTCGTTCTTGTATTGATACTATTCCAAAATCTCGTTGTACTGCTTTTCAATGTAAACA      SEQ ID NO: 1355
   1 ---------+---------+---------+---------+---------+---------+   60
         GCAAGAACATAACTATGATAAGGTTTTAGAGCAACATGACGAAAAGTTACATTTGT      SEQ ID NO: 1357

      G  R  S  C  I  D  T  I  P  K  S  R  C  T  A  F  Q  C  K  H    -  SEQ ID NO: 1356

     TTCTATGAAATATCGTCTTTCTTTTTGTCGTAAAACTTGTGGTACTTGTTCTGGTGGTGG
  61 ---------+---------+---------+---------+---------+---------+   120
     AAGATACTTTATAGCAGAAAGAAAAACAGCATTTTGAACACCATGAACAAGACCACCACC

      S  M  K  Y  R  L  S  F  C  R  K  T  C  G  T  C  S  G  G  G    -

     TGGTTCT //
 121 ---------+-                                                     131
     ACCAAGACCAC //

      G  S  G //                                                     -
```

Bacterial expression of the peptibody was as described in Example 3 and paste was stored frozen.

Example 54

Bacterial Expression of CH2-OSK1 Inhibitor of Kv1.3

The methods to clone and express the fusion of a CH2 domain of an Fc with OSK1 in bacteria were generally as described in Example 3. The vector used was pAMG21.G2.H6.G3.CH2.(G4S)2.OSK. Briefly, the pAMG21 vector was modified to remove the multi-cloning site's BamHI. This allowed the BamHI in front of the OSK as a site to swap out different sequences for fusion with the OSK. The sequence upstream of the OSK1 coding sequence was ligated between the NdeI and BamHI sites.

The sequence of the entire vector, including the insert was the following:

SEQ ID NO: 4914

```
gtcgtcaacgacccccattcaagaacagcaagcagcattgagaactttg
gaatccagtccctcttccacctgctgaccggatcagcagtccccggaaca
tcgtagctgacgccttcgcgttgctcagttgtccaaccccggaaacggga
aaaagcaagttttccccgctcccggcgtttcaataactgaaaaccatact
atttcacagtttaaatcacattaaacgacagtaatccccgttgatttgtg
cgccaacacagatcttcgtcacaattctcaagtcgctgatttcaaaaaac
tgtagtatcctctgcgaaacgatccctgtttgagtattgaggaggcgaga
tgtcgcagacagaaaatgcagtgacttcctcattgagtcaaaagcggttt
gtgcgcagaggtaagcctatgactgactctgagaaacaaatggccgttgt
tgcaagaaaacgtcttacacacaaagagataaaagtttttgtcaaaaatc
ctctgaaggatctcatggttgagtactgcgagagagaggggataacacag
gctcagttcgttgagaaaatcatcaaagatgaactgcaaagactggatat
actaaagtaaagactttactttgtggcgtagcatgctagattactgatcg
tttaaggaattttgtggctggccacgccgtaaggtggcaaggaactggtt
ctgatgtggatttacaggagccagaaaagcaaaaaccccgataatcttct
```

-continued

```
tcaacttttgcgagtacgaaaagattaccggggcccacttaaaccgtata
gccaacaattcagctatgcggggagtatagttatatgcccggaaaagttc
aagacttctttctgtgctcgctccttctgcgcattgtaagtgcaggatgg
tgtgactgatcttcaccaaacgtattaccgccaggtaaagaacccgaatc
cggtgtttacaccccgtgaaggtgcaggaacgctgaagttctgcgaaaaa
ctgatggaaaaggcggtgggcttcacttcccgttttgatttcgccattca
tgtggcgcacgcccgttcgcgtgatctgcgtcgccgtatgccaccagtgc
tgcgtcgtcgggctattgatgcgctcttgcaggggctgtgtttccactat
gacccgctggccaaccgcgtccagtgctccatcaccacgctggccattga
gtgcggactggcgacggagtctgctgccggaaaactctccatcacccgtg
ccacccgtgccctgacgttcctgtcagagctgggactgattacctaccag
acggaatatgacccgcttatcgggtgctacattccgaccgatatcacgtt
cacatctgcactgtttgctgccctcgatgtatcagaggaggcagtggccg
ccgcgcgccgcagccgtgtggtatgggaaaacaaacaacgcaaaaagcag
gggctggataccctgggcatggatgaactgatagcgaaagcctggcgttt
tgttcgtgagcgttttcgcagttatcagacagagcttaagtcccgtggaa
taaagcgtgcccgtgcgcgtcgtgatgcggacagggaacgtcaggatatt
gtcaccctggtgaaacggcagctgacgcgcgaaatcgcggaagggcgctt
cactgccaatcgtgaggcggtaaaacgcgaagttgagcgtcgtgtgaagg
agcgcatgattctgtcacgtaaccgtaattacagccggctggccacagct
tccccctgaaagtgacctcctctgaataatccggcctgcgccggaggctt
ccgcacgtctgaagcccgacagcgcacaaaaaatcagcaccacatacaaa
aaacaacctcatcatccagcttctggtgcatccggcccccctgttttcg
atacaaaacacgcctcacagacggggaattttgcttatccacattaaact
gcaagggacttccccataaggttacaaccgttcatgtcataaagcgccat
ccgccagcgttacagggtgcaatgtatcttttaaacacctgtttatatct
cctttaaactacttaattacattcatttaaaaagaaaacctattcactgc
ctgtccttggacagacagatatgcacctcccaccgcaagcggcgggcccc
```

-continued taccggagccgctttagttacaacactcagacacaaccaccagaaaaacc
ccggtccagcgcagaactgaaaccacaaagcccctccctcataactgaaa
agcggccccgccccggtccgaagggccggaacagagtcgcttttaattat
gaatgttgtaactacttcatcatcgctgtcagtcttctcgctggaagttc
tcagtacacgctcgtaagcggccctgacggcccgctaacgcggagatacg
ccccgacttcgggtaaaccctcgtcgggaccactccgaccgcgcacagaa
gctctctcatggctgaaagcgggtatggtctggcagggctggggatgggt
aaggtgaaatctatcaatcagtaccggcttacgccgggcttcggcggttt
tactcctgtttcatatatgaaacaacaggtcaccgccttccatgccgctg
atgcggcatatcctggtaacgatatctgaattgttatacatgtgtatata
cgtggtaatgacaaaaataggacaagttaaaaatttacaggcgatgcaat
gattcaaacacgtaatcaatatcgggggtgggcgaagaactccagcatga
gatccccgcgctggaggatcatccagccggcgtcccggaaaacgattccg
aagcccaacctttcatagaaggcggcggtggaatcgaaatctcgtgatgg
caggttgggcgtcgcttggtcggtcatttcgaaccccagagtcccgctca
gaagaactcgtcaagaaggcgatagaaggcgatgcgctgcgaatcgggag
cggcgataccgtaaagcacgaggaagcggtcagcccattcgccgccaagc
tcttcagcaatatcacgggtagccaacgctatgtcctgatagcggtccgc
cacacccagccggccacagtcgatgaatccagaaaagcggccattttcca
ccatgatattcggcaagcaggcatcgccatgagtcacgacgagatcctcg
ccgtcgggcatgcgcgccttgagcctggcgaacagttcggctggcgcgag
cccctgatgctcttcgtccagatcatcctgatcgacaagaccggcttcca
tccgagtacgtgctcgctcgatgcgatgtttcgcttggtggtcgaatggg
caggtagccggatcaagcgtatgcagccgccgcattgcatcagccatgat
ggatactttctcggcaggagcaaggtgagatgacaggagatcctgccccg
gcacttcgcccaatagcagccagtcccttcccgcttcagtgacaacgtcg
agcacagctgcgcaaggaacgcccgtcgtggccagccacgatagccgcgc
tgcctcgtcctgcaattcattcaggacaccggacaggtcggtcttgacaa
aaagaaccgggcgcccctgcgctgacagccggaacacggcggcatcagag
cagccgattgtctgttgtgcccagtcatagccgaatagcctctccaccca
agcggccggagaacctgcgtgcaatccatcttgttcaatcatgcgaaacg
atcctcatcctgtctcttgatctgatcttgatcccctgcgccatcagatc
cttggcggcaagaaagccatccagtttactttgcagggcttcccaacctt
accagagggcgccccagctggcaattccggttcgcttgctgtccataaaa
ccgcccagtctagctatcgccatgtaagcccactgcaagctacctgcttt
ctctttgcgcttgcgttttcccttgtccagatagcccagtagctgacatt
catccggggtcagcaccgtttctgcggactggctttctacgtgttccgct
tcctttagcagcccttgcgccctgagtgcttgcggcagcgtgaagctaca
tatatgtgatccgggcaaatcgctgaatattccttttgtctccgaccatc
aggcacctgagtcgctgtctttttcgtgacattcagttcgctgcgctcac -continued ggctctggcagtgaatgggggtaaatggcactacaggcgccttttatgga
ttcatgcaaggaaactacccataatacaagaaaagcccgtcacgggcttc
tcagggcgttttatggcgggtctgctatgtggtgctatctgactttttgc
tgttcagcagttcctgccctctgattttccagtctgaccacttcggatta
tcccgtgacaggtcattcagactggctaatgcacccagtaaggcagcggt
atcatcaacaggcttacccgtcttactgtcgaagacgtgcgtaacgtatg
catggtctccccatgcgagagtagggaactgccaggcatcaaataaaacg
aaaggctcagtcgaaagactgggcctttcgttttatctgttgtttgtcgg
tgaacgctctcctgagtaggacaaatccgccgggagcggatttgaacgtt
gcgaagcaacggcccggagggtggcgggcaggacgcccgccataaactgc
caggcatcaaattaagcagaaggccatcctgacggatggcctttttgcgt
ttctacaaactcttttgtttatttttctaaatacattcaaatatggacgt
cgtacttaacttttaaagtatgggcaatcaattgctcctgttaaaattgc
tttagaaatactttggcagcggtttgttgtattgagtttcatttgcgcat
tggttaaatggaaagtgaccgtgcgcttactacagcctaatatttttgaa
atatcccaagagcttttttccttcgcatgcccacgctaaacattctttttc
tcttttggttaaatcgttgtttgatttattatttgctatatttatttttc
gataattatcaactagagaaggaacaattaatggtatgttcatacacgca
tgtaaaaataaactatctatatagttgtctttctctgaatgtgcaaaact
aagcattccgaagccattattagcagtatgaatagggaaactaaacccag
tgataagacctgatgatttcgcttctttaattacatttggagatttttta
tttacagcattgttttcaaatatattccaattaatcggtgaatgattgga
gttagaataatctactataggatcatattttattaaattagcgtcatcat
aatattgcctccatttttttagggtaattatccagaattgaaatatcagat
ttaaccatagaatgaggataaatgatcgcgagtaaataatattcacaatg
taccattttagtcatatcagataagcattgattaatatcattattgcttc
tacaggctttaattttattaattattctgtaagtgtcgtcggcatttatg
tctttcatacccatctctttatccttacctattgtttgtcgcaagttttg
cgtgttatatatcattaaaacggtaatagattgacatttgattctaataa
attggatttttgtcacactattatatcgcttgaaatacaattgtttaaca
taagtacctgtaggatcgtacaggtttacgcaagaaaatggtttgttata
gtcgattaatcgatttgattctagatttgttttaactaattaaaggagga
ataacatatgggcggccatcatcatcatcatcatggcgggggaccgtcag
ttttcctcttccccccaaaacccaaggacaccctcatgatctcccggacc
cctgaggtcacatgcgtggtggtggacgtgagccacgaagaccctgaggt
caagttcaactggtacgtggacggcgtggaggtgcataatgccaagacaa
agccgcgggaggagcagtacaacagcacgtaccgtgtggtcagcgtcctc
accgtcctgcaccaggactggctgaatggcaaggagtacaagtgcaaggt
ctccaacaaagccctcccagcccccatcgagaaaaccatctccggcggcg
gcggcagcggcggcggcggatccggtgttatcatcaacgttaaatgcaaa -continued atctcccgtcagtgcctggaaccgtgcaaaaaagctggtatgcgtttcgg taaatgcatgaacggtaaatgccactgcaccccgaaataatgaattcgag ctcactagtgtcgacctgcagggtaccatggaagcttactcgaagatccg cggaaagaagaagaagaagaagaagaaagcccgaaaggaagctgagttggctg ctgccaccgctgagcaataactagcataaccccttggggcctctaaacgg gtcttgaggggttttttgctgaaaggaggaaccgctcttcacgctcttca cgcggataaataagtaacgatccggtccagtaatgacctcagaactccat ctggatttgttcagaacgctcggttgccgccgggcgtttttttattggtga gaatcgcagcaacttgtcgcgccaatcgagccatgtc//.

The insert DNA sequence was the following:

SEQ ID NO: 4915 atgggcggccatcatcatcatcatcatggcgggggaccgtcagttttcct cttccccccaaaacccaaggacaccctcatgatctcccggacccctgagg tcacatgcgtggtggtggacgtgagccacgaagaccctgaggtcaagttc aactggtacgtggacggcgtggaggtgcataatgccaagacaaagccgcg ggaggagcagtacaacagcacgtaccgtgtggtcagcgtcctcaccgtcc tgcaccaggactggctgaatggcaaggagtacaagtgcaaggtctccaac aaagccctcccagcccccatcgagaaaaccatctccggcggcggcggcag cggcggcggcggatccggtgttatcatcaacgttaaatgcaaaatctccc gtcagtgcctggaaccgtgcaaaaaagctggtatgcgtttcggtaaatgc atgaacggtaaatgccactgcaccccgaaa//.

The amino acid sequence of the CH2-OSK1 fusion protein product was the following:

SEQ ID NO: 4917

MGGHHHHHHGGGPSVFLFPPKPKDTLMISRTPEVTCVVVDVSHEDPEVKF
NWYVDGVEVHNAKTKPREEQYNSTYRVVSVLTVLHQDWLNGKEYKCKVSN
KALPAPIEKTISGGGGSGGGGSGVIINVKCKISRQCLEPCKKAGMRFGKC
MNGKCHCTPK//.

SEQ ID NO:4917 includes the OSK1 sequence (SEQ ID NO: 25)

GVIINVKCKISRQCLEPCKKAGMRFGKCMNGKCHCTPK.

Purification and refolding of CH2-OSK1 expressed in bacteria. Frozen, *E. coli* paste (13.8 g) was combined with 180 ml of room temperature 50 mM tris HCl, 5 mM EDTA, pH 8.0 and was brought to about 0.1 mg/ml hen egg white lysozyme. The suspended paste was passed through a chilled microfluidizer twice at 12,000 PSI. The cell lysate was then centrifuged at 17,700 g for 50 min at 4° C. The pellet was then resuspended in 90 ml 1% deoxycholate using a tissue grinder and then centrifuged at 15,300 g for 40 min at 4° C. The pellet was then resuspended in 90 ml water using a tissue grinder and then centrifuged at 15,300 g for 40 min at 4° C. The pellet (3.2 g) was then dissolved in 64 ml 8 M guanidine HCl, 50 mM tris HCl, pH 8.0. The suspension was then incubated at room temperature (about 23° C.) for 30 min with gentle agitation followed by centrifugation at 15,300 g for 30 min at 4° C. The supernatant (22 ml) was then reduced by adding 220 μl 1 M dithiothreitol and incubating at 37° C. for 30 minutes. The reduced suspension (20 ml) was transferred to 2000 ml of the refolding buffer (1 M urea, 50 mM ethanolamine, 160 mM arginine HCl, 0.02% $NaN_3$, 1.2 mM cystamine HCl, 4 mM cysteine, pH 9.8) at 4° C. with vigorous stirring. The stirring rate was then slowed and the incubation was continued for approximately 2.5 days at 4° C.

Ten milliliters of 500 mM imidazole was added to the refolding solution and the pH was adjusted to pH to 8.0 with 5 M acetic acid. The refold was then filtered through a 0.45 μm cellulose acetate filter with two pre-filters. This material was then loaded on to a 50 ml Qiagen Ni-NTA Superflow column (2.6 cm ID) in Ni-Buffer A (50 mM $NaH_2PO_4$, 300 mM NaCl, pH 7.5) at 15 ml/min 13° C. The column was then washed with 10 column volumes of Ni-Buffer A followed by 8% Ni-Buffer B (250 mM imidazole, 50 mM $NaH_2PO_4$, 300 mM NaCl, pH 7.5) at 25 ml/min. The column was then eluted with 60% Ni-Buffer B followed by 100% Ni-Buffer B at 10 ml/min. The peak fractions were collected and dialyzed against S-Buffer A (10 mM $NaH_2PO_4$, pH 7.1)

The dialyzed sample was then loaded on to a 5 ml Amersham SP-HP HiTrap column at 5 ml/min in S-Buffer A at 13° C. The column was then washed with several column volumes of S-Buffer A, followed by elution with a linear gradient from 0% to 60% S-Buffer B (10 mM $NaH_2PO_4$, 1 M NaCl, pH 7.1) followed by a step to 100% S-Buffer B at 1.5 ml/min 13° C. Fractions were then analyzed using a Coomassie brilliant blue stained tris-glycine 4-20% SDS-PAGE, and the fractions containing the desired product were pooled based on these data. The pool was then concentrated to about 1.6 ml using a Pall Macrosep with a 10 kDa membrane at 4° C. The concentrated sample was then filtered through a 0.22 μm cellulose acetate centrifugal filter.

A spectral scan was then conducted on 10 μl of the combined pool diluted in 150 μl water using a Hewlett Packard 8453 spectrophotometer (FIG. 78). The concentration of the filtered material was determined to be 3.35 mg/ml using a calculated molecular mass of 17,373 g/mol and extinction coefficient of 17,460 $M^{-1}$ $cm^{-1}$. The purity of the filtered material was then assessed using a Coomassie brilliant blue stained tris-glycine 4-20% SDS-PAGE (FIG. 79). The endotoxin level was then determined using a Charles River Laboratories Endosafe-PTS system (0.05-5 EU/ml sensitivity) using a 67-fold dilution of the sample in Charles Rivers Endotoxin Specific Buffer BG120 yielding a result of <1 EU/mg protein. The macromolecular state of the product was then determined using size exclusion chromatography on 50 μg of the product injected on to a Phenomenex BioSep SEC 3000 column (7.8×300 mm) in 50 mM $NaH_2PO_4$, 250 mM NaCl, pH 6.9 at 1 ml/min observing the absorbance at 280 nm (FIG. 80). The product was then subject to mass spectral analysis by chromatographing approximately 4 μg of the sample through a RP-HPLC column (Vydac $C_4$, 1×150 mm). Solvent A was 0.1% trifluoroacetic acid in water and solvent B was 0.1% trifluoroacetic acid in 90% acetonitrile, 10% water. The column was pre-equilibrated in 10% solvent B at a flow rate of 80 μl per min. The protein was eluted using a linear gradient of 10% to 90% solvent B over 30 min. Part of the effluent was directed into a LCQ ion trap mass spectrometer. The mass spectrum was deconvoluted using the Bioworks software provided by the mass spectrometer manufacturer. (FIG. 81). The product was then stored at −80° C.

PEGylation of CH2-OSK1. The CH2-OSK1 fusion protein was diluted to 2 mg/ml in 50 mM sodium acetate, 10 mM sodium cyanoborohydride, pH 4.8 with a 4-fold molar excess of 20 kD methoxy-PEG-aldehyde (Nektar Therapeutics, Huntsville, Ala.). The reaction was allowed to proceed overnight (~18 hrs) at 4° C. Upon completion, reaction was quenched with 4 volumes of 10 mM sodium acetate, 50 mM NaCl, pH 5, then loaded at 0.7 mg protein/ml resin to an SP Sepharose HP column (GE Healthcare, Piscataway, N.J.) equilibrated in 10 mM sodium acetate, 50 mM NaCl, pH 5. The mono-PEGylated CH2-Osk fusion was eluted with a linear 50 mM-1 M NaCl gradient (FIG. 82). Peak fractions were evaluated by SDS-PAGE and the mono-PEG-CH2-OSK1 fractions pooled, concentrated and dialyzed into Dulbecco's Phosphate Buffered Saline. The final product was analyzed by SDS-PAGE (FIG. 83).

As shown in Table 43, the purified CH2-OSK1 ("L2-6H-L3-CH2-L10-OsK1(1-38)") and PEGylated CH2-OSK1 ("20 k PEG-L2-6H-L3-CH2-L10-OSK1(1-38)") molecules were active in blocking inflammation in the human whole blood assay (See, Example 46).

Example 55

Bioactivity of OSK1 Peptide Analogs

The activity of OSK1 peptide analogs in blocking human Kv1.3 versus human Kv1.1 current is shown in FIGS. 84 through 86 and Tables 37-41. Three electrophysiology techniques were used (See, e.g., Example 36 and Example 44). Whole cell patch clamp (FIGS. 84 & 85 and Table 41) represents a low throughput technique which is well established in the field and has been available for many years. We also used two new planar patch clamp techniques, PatchXpress and IonWorks Quattro, with improved throughput which facilitate assessment of potency and selectivity of novel OSK1 analogs described in this application. The PatchXpress technique is of moderate throughput and the novel OSK1[Ala-12] analog (SEQ ID No:1410) had similar Kv1.3 potency and selectivity over Kv1.1 to that observed by whole cell patch clamp (FIG. 84 and Table 41). IonWorks Quattro represents a 384-well planar patch clamp electrophysiology system of high throughput. Using this IonWorks system, the novel OSK1[Ala-29] analog (SEQ ID No:1424) showed potent inhibition of the Kv1.3 current and improved selectivity over Kv1.1 (FIG. 86). The OSK1[Ala-29] analog (SEQ ID No:1424) showed similar Kv1.3 activity and selectivity over Kv1.1 by whole cell patch clamp electrophysiology (FIG. 85) to that observed by IonWorks (FIG. 86). The Kv1.3 and Kv1.1 activities of Alanine, Arginine, Glutamic acid and 1-Naphthylalanine analogs of OSK1 were determined by IonWorks electrophysiology and is reported in Tables 37-40. OSK1 peptide analogs identified by IonWorks to have good potency or Kv1.3 selectivity, were tested further in whole cell patch clamp studies (see, Table 41). The Kv1.3 IC50 of the His34Ala analog of OSK1 (SEQ ID No:1428) was 797 fold lower than its IC50 against Kv1.1 (Table 41), demonstrating that this analog is a highly selective Kv1.3 inhibitor. In this same assay, native OSK1 (SEQ ID NO: 25) showed only slight Kv1.3 selectivity, with the Kv1.1 IC50 being only 5 fold higher than Kv1.3.

Figure 90A:
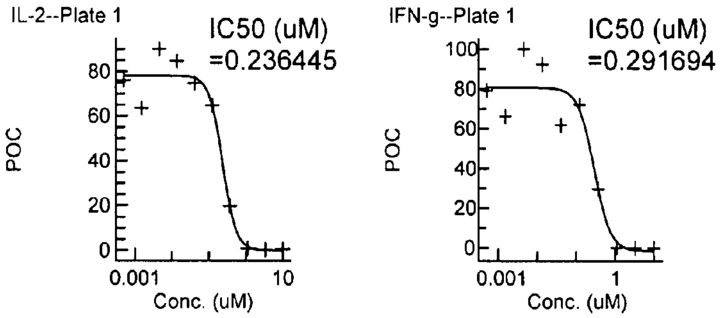
Figure 90B:
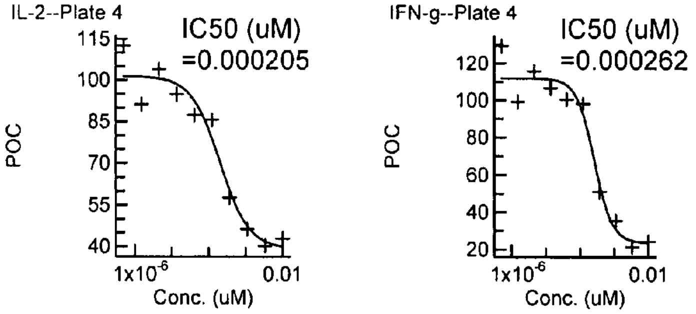
Figure 90C:
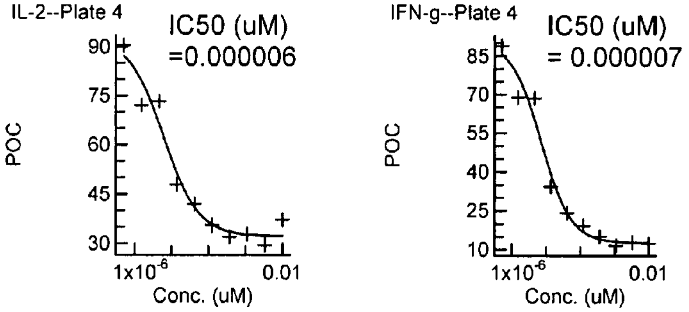
Figure 90D:
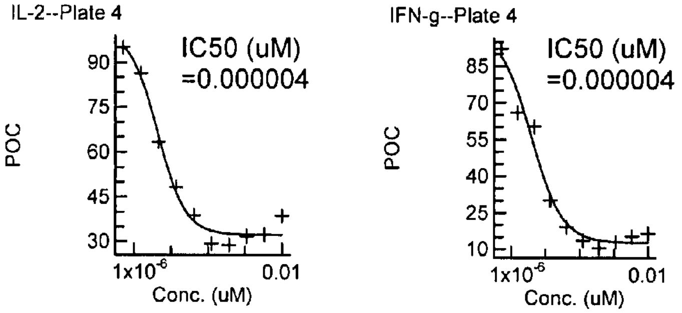

The novel OSK1 peptide analogs described in this application which inhibit Kv1.3 are useful in the treatment of autoimmune disease and inflammation. Kv1.3 is expressed on T cells and Kv1.3 inhibitors suppress inflammation by these cells. As one measure of inflammation mediated by T cells, we examined the impact of OSK1 analogs on IL-2 and IFN-g production in human whole blood following addition of a pro-inflammatory stimulus (Tables 36-40 and Table 42). "WB/IL-2" in these tables refers to the assay measuring IL-2 response of whole blood (see, Example 46), whereas "WB/IFNg" refers to the assay measuring IFNg response of whole blood (see, Example 46). The IC50 values listed in Tables 36-40 and 42, represent the average IC50 value determined from experiments done with two or more blood donors. The whole blood assay (see Example 46) allows for a combined measurement of the potency of the analogs in blocking inflammation and Kv1.3, as well as an assessment of the stability of the molecules in a complex biological fluid. Using this assay, several OSK1 analogs were examined and found to potently suppress inflammation (FIGS. 90C & 90D, Tables 36-40). Some of these analogs showed reduced activity in this whole blood assay, which may indicate that these residues play an important role in binding Kv1.3. Relative to the immunosuppressive agent cyclosporin A, Kv1.3 peptide inhibitors ShK-Ala22, OSK1-Ala29, and OSK1-Ala12 were several orders of magnitude more potent in blocking the cytokine response in human whole blood (FIG. 90).

The solution NMR structure of OSK1 has been solved and is provided as pdb accession number "1SCO" in Entrez's Molecular Modeling Database (MMDB) [J. Chen et al. (2003) Nucleic Acids Res. 31, 474-7]. FIG. 89 shows space filling (FIG. 89A, 89B, 89D) and worm (FIG. 89C) Cn3D rendering of the OSK1 structure. Light colored OSK1 amino acid residues Phe25, Gly26, Lys27, Met29 and Asn30 are shown in FIG. 89B. Some analogs of these residues were found to significantly reduce Kv1.3 activity (Tables 37-40), implying that these residues may make important contacts with the Kv1.3 channel. The molecular structure shown in FIG. 89A indicates these amino acids reside on a common surface of the OSK1 three-dimensional (3D) structure. FIG. 89D shows OSK1 residues (light shading) Ser11, Met29 and His34. These residues when converted to some amino acid analogs, provide improved Kv1.3 selectivity over Kv1.1 (Table 41). Although about 23 amino acids are between residues Ser11 and His34 in the contiguous polypeptide chain, the structure shown in FIG. 89D illustrates that in the 3D structure of the folded molecule these residues are relatively close to one another. Upon comparing FIGS. 89D and 89B, one can see that residues His34 and Ser11 (FIG. 89D) are on the left and right side, respectively, and adjacent to the major Kv1.3 contact surface displayed in FIG. 89B. It is envisioned that molecular modeling can be used to identify OSK1 analogs with improved Kv1.3 activity and selectivity, upon considering the Kv1.3 and Kv1.1 bioactivity information provided in Tables 37 through 42 and the solution NMR structure of OSK1 described above. FIG. 89C shows a worm rendering of the OSK1 structure with secondary structure elements (beta strands and alpha helices) depicted. The primary amino acid sequence of OSK1 is provided in FIG. 89E and amino acid residues comprising the beta strands & alpha helix are underlined. Wiggly lines in FIG. 89C indicate amino acid residues between or beyond these secondary structure elements, whereas straight lines depict the three disulfide bridges in OSK1. The first beta strand (β1) shown in FIGS. 89C and 89E contains no disulfide bridges to link it covalently to other secondary structure elements of the OSK1 molecule, unlike beta strand 3 (β3) that has two disulfide bridges with the alpha helix (α1). As shown in Table 42, OSK1 analogs without beta strand 1 (labeled "des 1-7") still retain activity in blocking inflammation (see SEQ ID No: 4989 of Table 42) suggesting that this region of OSK1 is not essential for the molecules Kv1.3 bioactivity.

OSK1 analogs containing multiple amino acid changes were generated and their activity in the human whole blood assay of inflammation is provided in Table 42. Several analogs retain high potency in this assay despite as many as 12 amino acid changes. Based on the improved Kv1.3 selectivity of analogs with single amino acid changes, anologs with multiple amino acid changes may result in additional improvements in selectivity. It is also envisioned that analogs with multiple amino acid changes may have improved activity or stability in vivo, alone or in the context of a peptide conjugate to a half-life prolonging moiety.

Kv1.3 peptide toxins conjugated to half-life prolonging moieties are provided within this application. The bioactivity of several toxin conjugates is described in Table 43. OSK1 analogs with a N-terminal half-life prolonging 20K PEG moiety (see Example 48) were found to provide potent suppression of the whole blood IL-2 ("WB/IL-2") and IFNg ("WB/IFNg") response (Table 43). The 20K PEG-ShK conjugate, shown earlier to have prolonged half-life in vivo (see Examples 44 and 48), was also highly active in this whole blood assay. The FcLoop-OSK1 conjugates (see Example 49) were highly active in blocking inflammation (Table 43), and the CH2-OSK1 or PEG-CH2-OSK1 conjugates (see Example 54) provided modest blockade of the whole blood cytokine response (Table 43). The IL-2 and IFNg cytokine response measured in this whole blood assay results from T cell activation. Since this cytokine response is Kv1.3 dependent and potently blocked by the Kv1.3 peptide and peptide-conjugate inhibitors described herein, these whole blood studies illustrate the therapeutic utility of these molecules in treatment of immune disorders.

TABLE 36

Activity of OSK1 analogs in blocking thapsigargin-induced IL-2 and IFNg production in 50% human whole blood as described in Example 46.

| | Thapsigargin Induced IL-2 & IFNg in Human Whole Blood | | | | | |
|---|---|---|---|---|---|---|
| | Average IC50 (nM) | Std Dev IC50 (nM) | Average IC50 (nM) | Std Dev IC50 (nM) | Analog $IC_{50}$ Divided by Ala-1 $IC_{50}$ | |
| OSK1 Analog | IL-2 | IL-2 | IFNg | IFNg | IL2 | IFNg |
| Ala-1 (SEQ ID No: 1400) | 0.1220 | 0.0791 | 0.1194 | 0.0802 | 1.00 | 1.00 |
| Ala-2 (SEQ ID No: 1401) | 0.0884 | 0.0733 | 0.1035 | 0.0776 | 0.72 | 0.87 |
| Ala-3 (SEQ ID No: 1402) | 0.0883 | 0.0558 | 0.0992 | 0.1007 | 0.72 | 0.83 |
| Ala-4 (SEQ ID No: 1403) | 0.1109 | 0.1098 | 0.0873 | 0.0993 | 0.91 | 0.73 |
| Ala-5 (SEQ ID No: 1404) | 0.0679 | 0.0566 | 0.0670 | 0.0446 | 0.56 | 0.56 |
| Ala-6 (SEQ ID No: 1405) | 0.0733 | 0.0477 | 0.0805 | 0.0696 | 0.60 | 0.67 |
| Ala-7 (SEQ ID No: 1406) | 0.0675 | 0.0383 | 0.0591 | 0.0260 | 0.55 | 0.49 |
| Ala-9 (SEQ ID No: 1407) | 0.0796 | 0.0761 | 0.0711 | 0.0627 | 0.65 | 0.60 |
| Ala-10 (SEQ ID No: 1408) | 0.0500 | 0.0425 | 0.0296 | 0.0084 | 0.41 | 0.25 |
| Ala-12 (SEQ ID No: 1410) | 0.1235 | 0.0823 | 0.1551 | 0.0666 | 1.01 | 1.30 |
| Ala-13 (SEQ ID No: 1411) | 0.1481 | 0.0040 | 0.1328 | 0.0153 | 1.21 | 1.11 |
| Ala-15 (SEQ ID No: 1412) | 0.1075 | | 0.1075 | | 0.88 | 0.90 |
| Ala-16 (SEQ ID No: 1413) | 0.1009 | | 0.1009 | | 0.83 | 0.84 |
| Ala-17 (SEQ ID No: 1414) | 0.1730 | | 0.1730 | | 1.42 | 1.45 |
| Ala-19 (SEQ ID No: 1415) | 0.1625 | | 0.1625 | | 1.33 | 1.36 |
| Ala-20 (SEQ ID No: 1416) | 0.3790 | | 0.3790 | | 3.11 | 3.17 |
| Ala-22 (SEQ ID No: 1418) | 7.0860 | | 7.0860 | | 58.07 | 59.33 |
| Ala-23 (SEQ ID No: 1419) | 0.2747 | | 0.2747 | | 2.25 | 2.30 |
| Ala-25 (SEQ ID No: 1421) | 3.0800 | | 3.0800 | | 25.24 | 25.79 |
| Ala-27 (SEQ ID No: 1423) | 3.4510 | 2.5781 | 1.5792 | 1.9217 | 28.28 | 13.22 |
| Ala-29 (SEQ ID No: 1424) | 0.4469 | 0.1727 | 0.2919 | 0.2422 | 3.66 | 2.44 |
| Ala-30 (SEQ ID No: 1425) | 0.9710 | 0.7538 | 0.6370 | 0.2674 | 7.96 | 5.33 |
| Ala-34 (SEQ ID No: 1428) | 0.0725 | 0.0275 | 0.0573 | 0.0341 | 0.59 | 0.48 |
| Pro-12, Lys-16, Asp-20, Ile-23, Ile-29, Ala-34 (SEQ ID No: 1393) | 0.5138 | 0.4064 | 0.5127 | 0.1597 | 4.21 | 4.29 |

TABLE 37

OSK1 Alanine Analogs.

| | | Analogue Activity (IC50, pM) | | | |
|---|---|---|---|---|---|
| SEQ ID NO: | Analogue | Kv1.3 | Kv1.1 | WB/IL-2 | WB/IFNg |
| 1400 | G1A | 41.11 | 13.89 | 122.035 | 119.425 |
| 1401 | V2A | 81.78 | 9.94 | 88.395 | 103.515 |
| 1402 | I3A | 96.59 | 10.64 | 88.255 | 99.16 |
| 1403 | I4A | 195.30 | 16.92 | 110.865 | 87.255 |
| 1404 | N5A | 159.98 | 14.01 | 67.91 | 66.985 |
| 1405 | V6A | 173.75 | 12.84 | 73.26 | 80.465 |
| 1406 | K7A | 181.04 | 21.88 | 67.5 | 59.075 |
| 1407 | K9A | 166.27 | 40.59 | 79.58 | 71.065 |
| 1408 | I10A | 91.23 | 4.46 | 49.97 | 29.63 |
| 1409 | S11A | 40.79 | 113.15 | 90 | 110 |
| 1410 | R12A | 389.90 | 55.89 | 123.49 | 155.1 |
| 1411 | Q13A | 249.46 | 21.65 | 148.05 | 132.75 |
| 1412 | L15A | 43.07 | 15.04 | 107.5 | 107.5 |
| 1413 | E16A | 21.55 | 6.87 | 100.9 | 100.9 |
| 1414 | P17A | 33.89 | 9.08 | 173 | 173 |
| 1415 | K19A | 210.48 | 16.85 | 162.5 | 162.5 |
| 1416 | K20A | 1036.08 | 185.01 | 379 | 379 |
| 1417 | | | | | |
| 1418 | G22A | >3000 | >3000 | 7086 | 7086 |
| 1419 | M23A | 71.39 | 38.63 | 274.7 | 274.7 |
| 1420 | R24A | >3000 | 1890.78 | | |
| 1421 | F25A | 1486.97 | 47.30 | 3080 | 3080 |

TABLE 37-continued

OSK1 Alanine Analogs.

| SEQ ID NO: | Analogue | Analogue Activity (IC50, pM) Kv1.3 | Kv1.1 | WB/IL-2 | WB/IFNg |
|---|---|---|---|---|---|
| 1422 | G26A | 710.98 | 733.36 | 12075 | 10730 |
| 1423 | K27A | 232.44 | >3000 | 1232 | 1579.15 |
| 1424 | M29A | 59.47 | >3333 | 446.9 | 291.85 |
| 1425 | N30A | 692.54 | >3000 | 971 | 637 |
| 1426 | G31A | 70.17 | 61.78 | | |
| 1427 | K32A | | | 41.3 | 34 |
| 1428 | H34A | 19.36 | 368.41 | 72.54 | 57.29 |
| 1429 | T36A | | | 728.4 | 723.5 |
| 1430 | P37A | | | 956 | 849.7 |
| 1431 | K38A | | | 221 | 343 |

TABLE 38

OSK1 Arginine Analogs.

| SEQ ID NO: | Analogue | Analogue Activity (IC50, pM) Kv1.3 | Kv1.1 | WB/IL-2 | WB/IFNg |
|---|---|---|---|---|---|
| 1432 | G1R | 68.75 | 9.91 | 554 | 991 |
| 1433 | V2R | 133.34 | 25.79 | 775 | 986 |
| 1434 | I3R | 19.90 | 2.47 | 148 | 180 |
| 1435 | I4R | 10.41 | 1.92 | 168 | 175 |
| 1436 | N5R | 13.62 | 2.15 | 95 | 120 |
| 1437 | V6R | 8.65 | 2.40 | 84 | 115 |
| 1438 | K7R | 13.17 | <1.52401 | 78 | 71 |
| 1439 | K9R | 11.99 | 2.01 | 107 | 77 |
| 1440 | I10R | 11.68 | 1.73 | 307 | 474 |
| 1441 | S11R | 16.72 | 210.05 | 2118 | 4070 |
| 1442 | Q13R | 15.34 | <1.52401 | 160 | 172 |
| 1443 | L15R | 13.73 | 2.16 | 93 | 116 |
| 1444 | E16R | 10.36 | <1.52401 | 556 | 454 |
| 1445 | P17R | 10.42 | <1.52401 | 202 | 355 |
| 1446 | K19R | 12.57 | 2.41 | 44 | 62 |
| 1447 | K20R | 9.85 | <1.52401 | 67 | 83 |
| 1448 | A21R | 14.92 | 2.61 | 90 | 149 |
| 1449 | G22R | 23.74 | 3.49 | 292 | 349 |
| 1450 | M23R | 12.34 | 2.01 | 182 | 148 |
| 1451 | F25R | >3333 | 817.42 | 25027 | 30963 |
| 1452 | G26R | >3333 | >3333 | 100000 | 100000 |
| 1453 | K27R | 1492.94 | >3333 | 15088 | 10659 |
| 1454 | M29R | 200.39 | 1872.11 | 11680 | 7677 |
| 1455 | N30R | 18.90 | 45.71 | 405 | 445 |
| 1456 | G31R | 22.16 | 1.59 | 314 | 343 |
| 1457 | K32R | 30.83 | 7.24 | 28 | 34 |
| 1458 | H34R | 13.57 | 4.49 | 92 | 108 |
| 1459 | T36R | 1308.07 | 26.55 | 9697 | 10050 |
| 1460 | P37R | 13.32 | 2.01 | 229 | 253 |
| 1461 | K38R | 14.99 | 1.84 | 39 | 40 |

TABLE 39

OSK1 Glutamic Acid Analogs.

| SEQ ID NO: | Analogue | Analogue Activity (IC50, pM) Kv1.3 | Kv1.1 | WB/IL-2 | WB/IFNg |
|---|---|---|---|---|---|
| 1462 | G1E | 185.78 | 50.97 | 1217 | 1252 |
| 1463 | V2E | 36.23 | 35.01 | 97 | 184 |
| 1464 | I3E | 22.00 | 42.99 | 120 | 160 |
| 1465 | I4E | 15.65 | 3.19 | 218 | 191 |
| 1466 | N5E | 23.38 | 4.44 | 100 | 65 |
| 1467 | V6E | 17.73 | 2.43 | 48 | 68 |
| 1468 | K7E | 14.16 | <1.52401 | 58 | 68 |
| 1469 | K9E | 31.76 | 110.67 | 179 | 171 |
| 1470 | I10E | 120.35 | 33.50 | 2573 | 2736 |
| 1471 | S11E | >3333 | >3333 | 39878 | 16927 |

TABLE 39-continued

OSK1 Glutamic Acid Analogs.

| SEQ ID NO: | Analogue | Analogue Activity (IC50, pM) Kv1.3 | Kv1.1 | WB/IL-2 | WB/IFNg |
|---|---|---|---|---|---|
| 1472 | R12E | 89.71 | 193.25 | 1787 | 2001 |
| 1473 | Q13E | 45.87 | 6.28 | 1063 | 799 |
| 1474 | L15E | 47.48 | 436.05 | 785 | 1059 |
| 1475 | P17E | 14.47 | 1.81 | 520 | 947 |
| 1476 | K19E | 23.51 | 13.71 | | |
| 1477 | K20E | 25.45 | 5.76 | | |
| 1478 | A21E | 7.37 | <1.52401 | 117 | 138 |
| 1479 | G22E | 13.88 | 2.56 | 109 | 164 |
| 1480 | M23E | 24.28 | 10.44 | 606 | 666 |
| 1481 | R24E | | | 7161 | 9543 |
| 1482 | F25E | >3333 | >3333 | 100000 | 100000 |
| 1483 | G26E | >3333 | >3333 | 100000 | 100000 |
| 1484 | K27E | >3333 | 548.55 | 5548 | 7144 |
| 1485 | M29E | >3333 | >3333 | 27099 | 24646 |
| 1486 | N30E | | | 14024 | 24372 |
| 1487 | G31E | 12.01 | 2.37 | 95 | 111 |
| 1488 | K32E | 15.56 | 17.31 | 62 | 63 |
| 1489 | H34E | 330.15 | 1689.82 | 1618 | 2378 |
| 1490 | T36E | 161.06 | >3333 | 1742 | 2420 |
| 1491 | P37E | 62.67 | 622.18 | 239 | 1604 |
| 1492 | K38E | 25.76 | 34.33 | 526 | 713 |

TABLE 40

OSK1 Naphthylalanine Analogs.

| SEQ ID NO: | Analogue | Analogue Activity (IC50, pM) Kv1.3 | Kv1.1 | WB/IL-2 | WB/IFNg |
|---|---|---|---|---|---|
| 1493 | G1Nal | 20.66 | 33.93 | 2793 | 2565 |
| 1494 | V2Nal | 11.55 | 2.46 | 750 | 524 |
| 1495 | I3Nal | 10.31 | 2.34 | 907 | 739 |
| 1496 | I4Nal | 15.03 | <1.52401 | 1094 | 1014 |
| 1497 | N5Nal | 21.78 | <1.52401 | 760 | 431 |
| 1498 | V6Nal | 20.97 | <1.52401 | 1776 | 2465 |
| 1499 | K7Nal | 23.61 | <1.52401 | 222 | 246 |
| 1500 | K9Nal | 65.82 | 2.92 | 1070 | 1217 |
| 1501 | I10Nal | 45.44 | <1.52401 | 184 | 257 |
| 1502 | S11Nal | 95.87 | >3333 | 23915 | 17939 |
| 1503 | R12Nal | 37.66 | 24.99 | 460 | 387 |
| 1504 | Q13Nal | 13.44 | <1.52401 | 140 | 198 |
| 1505 | L15Nal | 17.84 | <1.52401 | 358 | 370 |
| 1506 | E16Nal | 9.58 | <1.52401 | 1025 | 1511 |
| 1507 | P17Nal | 16.19 | <1.52401 | 193 | 357 |
| 1508 | K19Nal | 17.22 | <1.52401 | 58 | 99 |
| 1509 | K20Nal | 13.53 | <1.52401 | 74 | 125 |
| 1510 | A21Nal | 26.10 | <1.52401 | 315 | 434 |
| 1511 | G22Nal | >3333 | 426.27 | 10328 | 10627 |
| 1512 | M23Nal | 35.96 | 64.37 | 581 | 1113 |
| 1513 | R24Nal | 45.26 | 2.85 | 293 | 818 |
| 1514 | F25Nal | 28.63 | 51.75 | 1733 | 1686 |
| 1515 | G26Nal | >3333 | 1573.75 | 9898 | 10651 |
| 1516 | K27Nal | >3333 | 1042.84 | 14971 | 27025 |
| 1517 | M29Nal | 93.46 | 46.88 | 100000 | 100000 |
| 1518 | N30Nal | >3333 | 1283.88 | 100000 | 37043 |
| 1519 | G31Nal | 33.76 | <1.52401 | 331 | 467 |
| 1520 | K23Nal | 26.13 | 1.91 | 134 | 196 |
| 1521 | H34Nal | 60.31 | >3333 | 3323 | 6186 |
| 1522 | T36Nal | | | 100000 | 37811 |
| 1523 | P37Nal | 70.80 | 6.74 | 1762 | 3037 |
| 1524 | K38Nal | | | 308 | 409 |

TABLE 41

OSK1 Analogues with Improved Selectivity at Kv1.3 over Kv1.1 (whole cell patch clamp ePhys).

| SEQ ID NO: | Analogue | Kv1.3 (IC50, pM) | Kv1.1 (IC50, pM) | Kv1.3 Selectivity (=Kv1.1/Kv.3 IC50) |
|---|---|---|---|---|
| 25 | wild-type | 39 | 202 | 5 |
| 1441 | S11R | 40 | 9130 | 228 |
| 1502 | S11Nal | 1490 | 85324 | 57 |
| 1410 | R12A | 25 | 440 | 17 |
| 1474 | L15E | 190 | 65014 | 342 |
| 1423 | K27A | 289 | 10085* | 35 |
| 1424 | M29A | 33 | 3472 | 105 |
| 1454 | M29R | 760 | 23028 | 30 |
| 1425 | N30A | 766 | 10168 | 14 |
| 1428 | H34A | 16 | 12754 | 797 |
| 1521 | H34Nal | 215 | 29178 | 136 |
| 1489 | H34E | 1322 | 39352 | 30 |
| 1490 | T36E | 1921 | 83914 | 44 |
| 1491 | P37E | 241 | 15699 | 65 |

*PatchXpress data

TABLE 42

OSK1 Analogues with Multiple Amino Acid Substitutions.

| SEQ ID NO: | # Amino Acid Changes | Amino Acid Changes | WB/IL-2 (IC50, nM) | WB/IFNg (IC50, nM) |
|---|---|---|---|---|
| 4988 | 2 | M29A, H34Nal | 0.087 | 0.102 |
| 296 | 2 | E16K, K20D | 1.579 | 1.32 |
| 4986 | 2 | I4K(Gly), H34A | 0.470 | 0.451 |
| 4987 | 2 | H34A, K38K(Gly) | 1.249 | 2.380 |
| 4985 | 2 | K19K(Gly), H34A | 1.514 | 1.633 |
| 1392 | 3 | R12A, E16K, K20D | 0.041 | 0.092 |
| 4990 | 3 | E16K, K20D, H34A | 65.462 | 26.629 |
| 298 | 3 | E16K, K20D, T36Y | 0.639 | 0.923 |
| 4991 | 4 | S11Nal, R12A, M29A, H34Nal | 12.665 | 14.151 |
| 1396 | 5 | E16K, K20D, des36-38 | 3.941 | 6.988 |
| 1395 | 5 | GGGGS-Osk1 | 1.357 | 2.204 |
| 1274 | 5 | E16K, K20D, T36G, P37G, K38G | 2.636 | 3.639 |
| 4992 | 5 | S11Nal, R12A, M29A, H34Nal, P37E | 3.511 | 5.728 |
| 4994 | 5 | S11Nal, R12A, M23F, M29A, H34Nal | 8.136 | 22.727 |
| 1398 | 5 | R12P, E16K, K20D, T37Y, K38Nle | 0.527 | 0.736 |
| 1397 | 5 | R12P, E16Om, K20E, T37Y, K38Nle | 6.611 | 18.454 |
| 4995 | 6 | S11Nal, R12A, M23Nle, M29A, H34Nal, P37E | 14.32 | 68.158 |
| 4916 | 7 | des1, V2G, R12A, E16K, K19R, K20D, H34A | 1.499 | 2.244 |
| 4993 | 7 | S11Nal, R12A, L15E, M29A, H34Nal, T36E, P37E | >100 | >100 |
| 4989 | 12 | des1-7, E16K, K20D, des36-38 | 8.179 | 8.341 |

TABLE 43

Bioactivity of OSK1 and OSK1 peptide analog conjugates with half-life-extending moieties as indicated. Fcloop structures G2-OSK1-G2 (SEQ ID NO: 976), G4-OSK1-G2 (SEQ ID NO: 979), and G2-ShK-G2 (SEQ ID NO: 977) are described in Example 49, and CH2-L10-OSK1(1-38) SEQ ID NO: 4917 is described in Example 54.

| $F^1$ (and $F^2$, if present) | Short-hand Designation | WB/IL-2 (IC50, nM) | WB/IFNg (IC50, nM) |
|---|---|---|---|
| PEG | 20k PEG-OSK1[Ala12] | 0.270 | 0.137 |
| PEG | 20k PEG-OSK1[Ala29] | 5.756 | 5.577 |
| PEG | 20k PEG-OSK1[Ala29, 1Nal34] | 0.049 | 0.081 |
| PEG | 20k PEG-OSK1[1Nal11] | 0.019 | 0.027 |
| PEG | 20k PEG-ShK | 0.046 | 0.065 |
| FcLoop | FcLoop-G2-OSK-G2 | 0.028 | 0.056 |
| FcLoop | FcLoop-G4-OSK-G2 | 0.150 | 0.195 |
| FcLoop | FcLoop-G2-ShK-G2 | 0.109 | 0.119 |
| PEG- | 20k PEG-L2-6H-L3-CH2-L10- | 8.325 | 50.144 |

TABLE 43-continued

Bioactivity of OSK1 and OSK1 peptide analog conjugates with half-life-extending moieties as indicated. Fcloop structures G2-OSK1-G2 (SEQ ID NO: 976), G4-OSK1-G2 (SEQ ID NO: 979), and G2-ShK-G2 (SEQ ID NO: 977) are described in Example 49, and CH2-L10-OSK1(1-38) SEQ ID NO: 4917 is described in Example 54.

| $F^1$ (and $F^2$, if present) | Short-hand Designation | WB/IL-2 (IC50, nM) | WB/IFNg (IC50, nM) |
|---|---|---|---|
| CH2 | OsK1 (1-38) | | |
| CH2 | L2-6H-L3-CH2-L10-OsK1 (1-38) | 38.491 | 55.162 |

Example 56

Design and Expression of Monovalent Fc-Fusion Molecules

There may be pharmacokinetic or other reasons, in some cases, to prefer a monovalent dimeric Fc-toxin peptide fusion (as represented schematically in FIG. 2B) to a ("bivalent") dimer (as represented schematically in FIG. 2C). However, conventional Fc fusion constructs typically result in a mixture containing predominantly dimeric molecules, both monovalent and bivalent. Monovalent dimeric Fc-toxin peptide fusions (or "peptibodies"), including monovalent dimeric Fc-OSK1 peptide analog fusions and Fc-ShK peptide analog fusions, can be isolated from conditioned media which also contains bivalent dimeric Fc-toxin peptide, and dimeric Fc lacking the toxin peptide fusion. Separation of all three species can be accomplished using ion exchange chromatography, for example, as described in Examples 1, 2, and 41 herein.

A number of other exemplary ways that a monovalent dimeric Fc-toxin peptide fusion can be produced with greater efficiency are provided here, including for the production of monovalent dimeric Fc-OSK1 peptide analog fusions:

(1) Co-expressing equal amounts of Fc and Fc-toxin peptide in the same cells (e.g. mammalian cells). With the appropriate design, a mixture of bivalent dimeric Fc-toxin peptide fusion, monovalent dimeric Fc-toxin peptide fusion and dimeric Fc will be produced and released into the conditioned media. The monovalent dimeric Fc-toxin peptide can be purified from the mixture using conventional purification methods, for example, methods described in Examples 1, 2, and 41 herein.

(2) Engineering and recombinantly expressing in mammalian cells a single polypeptide construct represented by the following schematic:

Signal peptide-Fc-furin cleavage site-linker-furin cleavage site-Fc-toxin peptide Furin cleavage occurs as the molecule travels through the endoplasmic reticulum and the intra-molecular Fc pairing (resulting in monovalent dimeric Fc-toxin peptide fusion) can occur preferentially to intermolecular Fc pairing (resulting in dimeric Fc-toxin peptide being expressed into conditioned medium; FIG. 87A-B).

By way of example of method (2) above, a DNA construct was produced for recombinant expression in mammalian cells of the following schematic polypeptide construct:

Signal peptide-Fc-furin cleavage site-linker-furin cleavage site-Fc-ShK(2-35)

The DNA construct had the following nucleotide coding sequence:

SEQ ID NO: 5007 atggaatggagctgggtctttctcttcttcctgtcagtaacgactggtgt
ccactccgacaaaactcacacatgcccaccgtgcccagcacctgaactcc
tggggggaccgtcagtcttcctcttccccccaaaacccaaggacaccctc
atgatctcccggacccctgaggtcacatgcgtggtggtggacgtgagcca
cgaagaccctgaggtcaagttcaactggtacgtggacggcgtggaggtgc
ataatgccaagacaaagccgcgggaggagcagtacaacagcacgtaccgt
gtggtcagcgtcctcaccgtcctgcaccaggactggctgaatggcaagga
gtacaagtgcaaggtctccaacaaagccctcccagcccccatcgagaaaa
ccatctccaaagccaaagggcagccccgagaaccacaggtgtacaccctg
cccccatcccgggatgagctgaccaagaaccaggtcagcctgacctgcct
ggtcaaaggcttctatcccagcgacatcgccgtggagtgggagagcaatg
ggcagccggagaacaactacaagaccacgcctcccgtgctggactccgac
ggctccttcttcctctacagcaagctcaccgtggacaagagcaggtggca
gcaggggaacgtcttctcatgctccgtgatgcatgaggctctgcacaacc
actacacgcagaagagcctctccctgtctccgggtaaacgaggcaagagg
gctgtgggggggcggtgggagcggcggcgggggctcaggtggcgggggaag
tggcgggggagggagtggagggggagggagtggaggcgggggatccggcg
gggggggtagcaagcgtcgcgagaagcgggataagacccatacctgcccc
ccctgtcccgcgcccgagttgctcgggggccccagcgtgtttttgtttcc
tcccaagcctaaagatacattgatgattagtagaacacccgaagtgacct
gtgtcgtcgtcgatgtctctcatgaggatcccgaagtgaaattcaattgg
tatgtcgatggggtcgaagtccacaacgctaaaaccaaacccagagaaga
acagtataattctacctatagggtcgtgtctgtgttgacagtgctccatc -continued aagattggctcaacgggaaagaatacaaatgtaaagtgagtaataaggct
ttgcccgctcctattgaaaagacaattagtaaggctaagggccaacctag
ggagccccaagtctatacactccctcccagtagagacgagctgaccaaga
accaggtcagcctgacctgcctggtcaaaggcttctatcccagcgacatc
gccgtggagtgggagagcaatgggcagccggagaacaactacaagaccac
gcctcccgtgctggactccgacggctccttcttcctctacagcaagctca
ccgtggacaagagcaggtggcagcaggggaacgtcttctcatgctccgtg
atgcatgaggctctgcacaaccactacacgcagaagagcctctccctgtc
tccgggtaaaggaggaggaggatccggaggaggaggaagcagctgcatcg
acaccatccccaagagccgctgcaccgccttccagtgcaagcacagcatg
aagtaccgcctgagcttctgccgcaagacctgcggcacctgctaa //.

The resulting expressed polypeptide (from vector pTT5-Fc-Fc-L10-Shk(2-35)) had the following amino acid sequence before furin cleavage (the first 19 residues are a signal peptide sequence; furin cleavage sites are underlined):

SEQ ID NO: 5008 mewswvflfflsvttgvhsdkthtcppcpapellggpsvflfppkpkdtl
misrtpevtcvvvdvshedpevkfnwyvdgvevhnaktkpreeqynstyr
vvsvltvlhqdwlngkeykckvsnkalpapiektiskakgqprepqvytl
ppsrdeltknqvsltclvkgfypsdiavewesngqpennykttppvldsd
gsfflyskltvdksrwqqgnvfscsvmhealhnhytqkslslspgkrqkr
avggggsggggsggggsggggsggggsggggsggggskrrekrdkthtcp
pcpapellggpsvflfppkpkdtlmisrtpevtcvvvdvshedpevkfnw
yvdgvevhnaktkpreeqynstyrvvsvltvlhqdwlngkeykckvsnka
lpapiektiskakgqprepqvytlppsrdeltknqvsltclvkgfypsdi
avewesngqpennykttppvldsdgsfflyskltvdksrwqqgnvfscsv
mhealhnhytqkslslspgkggggsggggsscidtipksrctafqckhsm
kyrlsfcrktcgtc //.

FIG. 87A-B demonstrates recombinant expression of a monovalent dimeric Fc-L-ShK(2-35) molecule product expressed by and released into the conditioned media from transiently transfected mammalian cells. FIG. 88 shows results from a pharmacokinetic study on the monovalent dimeric Fc-ShK(1-35) in SD rats. Serum samples were added to microtiter plates coated with an anti-human Fc antibody to enable affinity capture. Plates were then washed, captured samples were released by SDS and run on a polyacrylamide gel. Samples were then visualized by western blot using an anti-human Fc-specific antibody and secondary-HRP conjugate. The MW of bands from serum samples is roughly identical to the original purified material, suggesting little, if any, degradation of the protein occurred in vivo over a pro-longed half-life, in spite of the presence of Arg at position 1 of the ShK(1-35) sequence.

(3) Similar to (2) above, a Fc-toxin peptide fusion monomer can be conjugated with an immunoglobulin light chain and heavy chain resulting in a monovalent chimeric immunoglobulin-Fc-toxin peptide molecule. We have termed an immunoglobulin (light chain+heavy chain)-Fc construct a "hemibody"; such "hemibodies" containing a dimeric Fc portion can provide the long half-life typical of a dimeric antibody. The schematic representation in FIG. 92A-C illustrates an embodiment of a hemibody-toxin peptide fusion protein and its recombinant expression by mammalian cells.

If the antibody chosen is a target specific antibody (e.g., an anti-Kv1.3 or anti-IKCa1 antibody), the chimeric molecule may also enhance the targeting efficiency of the toxin peptide. FIG. 91A-B demonstrates that such chimeric molecules, in this example Fc-L10-ShK(2-35) dimerized with human IgG1 or human IgG2 light and heavy chains, can be expressed and released into the conditioned media from transfected mammalian cells.

Example 57

Osk1 PEGylated at Residue 4 by Oxime Formation

[Dp$^{(AOA)-PEG)}$4]Osk1 Peptide Synthesis of reduced [Dpr$^{(AOA)}$4]Osk1. [Dpr$^{(AOA)}$4]Osk1, having the sequence:

```
                                          (SEQ ID NO: 5009)
CVI[Dpr(AOA)]NVKCKISRQCLEPCKKAGMRFGKCMNGKCHCTPK
```

can be synthesized in a stepwise manner on a Symphony™ multi-peptide synthesizer by solid-phase peptide synthesis (SPPS) using 2-(1H-benzotriazole-1-yl)-1,1,3,3-tetramethyluronium hexafluorophosphate (HBTU)/N-methyl morpholine (NMM)/N,N-dimethyl-formamide (DMF) coupling chemistry at 0.1 mmol equivalent resin scale on Fmoc-Lys (Boc)-Wang resin (Novabiochem). N-alpha-(9-fluorenylmethyloxycarbonyl)- and side-chain protected amino acids can be purchased from Novabiochem. The following side-chain protection strategy can be employed: Asp(O$^t$Bu), Arg(Pbf), Cys(Trt), Gln(Trt), His(Trt), Lys(N$^ε$-Boc), Ser(O$^t$Bu), Thr (O$^t$Bu) and Tyr(O$^t$Bu). Dpr(AOA), i.e., N-α-Fmoc-N-b-(N-t.-Boc-amino-oxyacetyl)-L-diaminopropionic acid, can be purchased from Novabiochem (Cat. No. 04-12-1185). The protected amino acid derivatives (20 mmol) can be dissolved in 100 ml 20% dimethyl sulfoxide (DMSO) in DMF (v/v). Protected amino acids can be activated with 200 mM HBTU, 400 mM NMM in 20% DMSO in DMF, and coupling can be carried out using two treatments with 0.5 mmol protected amino acid, 0.5 mmol HBTU, 1 mmol NMM in 20% DMF/DMSO for 25 minutes and then 40 minutes. Fmoc deprotection reactions can be carried out with two treatments using a 20% piperidine in DMF (v/v) solution for 10 minutes then 15 minutes. Following synthesis and removal of the N-terminal Fmoc group, the resin can be then drained, and washed with DCM, DMF, DCM, and then dried in vacuo. The peptide-resin can be deprotected and released from the resin by treatment with a TFA/amionooxyacetic acid/TIS/EDT/H2O (90:2.5:2.5:2.5:2.5) solution at room temperature for 1 hour. The volatiles can be then removed with a stream of nitrogen gas, the crude peptide precipitated twice with cold diethyl ether and collected by centrifugation. The [Dpr$^{(AOA)}$4]Osk1 peptide can be then analyzed on a Waters 2795 analytical RP-HPLC system using a linear gradient (0-60% buffer B in 12 minutes, A: 0.1% TFA in water also containing 0.1% aminooxyacetic acid, B: 0.1% TFA in acetonitrile) on a Jupiter 4 μm Proteo™ 90 Å column.

Reversed-Phase HPLC Purification. Preparative Reversed-phase high-performance liquid chromatography can be performed on C18, 5 μm, 2.2 cm×25 cm) column. The [Dpr$^{(AOA)}$4]Osk1 peptide is dissolved in 50% aqueous acetronitrile containing acetic acid and amionooxyacetic acid and loaded onto a preparative HPLC column. Chromatographic separations can be achieved using linear gradients of buffer B in A (A=0.1% aqueous TFA; B=90% aq. ACN containing 0.09% TFA), typically 5-95% over 90 minutes at 15 mL/min. Preparative HPLC fractions can be characterized by ESMS and photodiode array (PDA) HPLC, combined and lyophilized.

Osk1 peptide analog PEGylated at residue 4 by oxime formation: [Dpr$^{(AOA)-PEG)}$4]Osk1 (i.e., GVI[Dpr$^{(AOA-PEG)}$]NVKCKISRQCLEPCKKAGMRFGKCMNGKCHCTPK// SEQ ID NO:5010) can be made as follows. Lyophilized [Dpr$^{(AOA)}$4]Osk1 peptide can be dissolved in 50% HPLC buffer A/B (5 mg/mL) and added to a two-fold molar excess of MeO-PEG-aldehyde, $CH_3O—[CH_2CH_2O]_n—CH_2CH_2CHO$ (average molecular weight 20 kDa). The aminoxyacetyl group within the peptide at residue 4 reacts with the aldehyde group of the PEG to form a covalent oxime linkage. The reaction can be left for 24 hours, and can be analyzed on an Agilent™ 1100 RP-HPLC system using Zorbax™ 300SB-C8 5 μm column at 40° C. with a linear gradient (6-60% B in 16 minutes, A: 0.1% TFA in water, B: 0.1% TFA/90% ACN in water). Mono PEGylated [Dpr$^{(AOA)-PEG)}$4]Osk1 peptide can be then isolated using a HiTrap™ 5 mL SP HP cation exchange column on AKTA FPLC system at 4° C. at 1 mL/min using a gradient of 0-50% B in 25 column volumes (Buffers: A=20 mM sodium acetate pH 4.0, B=1 M NaCl, 20 mM sodium acetate, pH 4.0). The fractions can be analyzed using a 4-20 tris-Gly SDS-PAGE gel and RP-HPLC. SDS-PAGE gels can be run for 1.5 hours at 125 V, 35 mA, 5 W. Pooled product, mono-PEGylated [Dpr$^{(AOA)-PEG)}$4]Osk1 peptide, can be then dialyzed at 4° C. in 3 changes of 1 L of A4S buffer (10 mM NaOAc, 5% sorbitol, pH 4.0). The dialyzed product can be then concentrated in 10 K microcentrifuge filter to 2 mL volume and sterile-filtered using 0.2 μM syringe filter to give the final product.

Folding of [Dpr$^{(AOA)-PEG)}$4]Osk1 (Disulphide bond formation). The mono-PEGylated [Dpr$^{(AOA)-PEG)}$4]Osk1 peptide can be dissolved in 20% AcOH in water (v/v) and can be then diluted with water to a concentration of approximately 0.15 mg peptide mL, the pH adjusted to about 8.0 using $NH_4OH$ (28-30%), and gently stirred at room temperature for 36 hours. Folding process can be monitored by LC-MS analysis. Following this, folded mono-PEGylated [Dpr$^{(AOA)-PEG)}$4]Osk1 can be purified using by reversed phase HPLC using a 1" Luna 5 μm C18 100 Å Proteo™ column with a linear gradient 0-40% buffer B in 120 min (A=0.1% TFA in water, B=0.1% TFA in acetonitrile). Mono-PEGylated (oximated) [Dpr$^{(AOA)-PEG)}$4]Osk1 peptide disulfide connectivity can be C1-C4, C2-C5, and C3-C6.

ABBREVIATIONS

Abbreviations used throughout this specification are as defined below, unless otherwise defined in specific circumstances.

| | |
|---|---|
| Ac | acetyl (uses to reter to acetylated residues) |
| AcBpa | acetylated p-benzoyl-L-phenylalanine |
| ADCC | antibody-dependent cellular cytotoxicity |
| Aib | aminoisobutyric acid |
| bA | beta-alanine |
| Bpa | p-benzoyl-L-phenylalanine |
| BrAc | bromoacetyl ($BrCH_2C(O)$) |
| BSA | Bovine serum albumin |
| Bzl | Benzyl |
| Cap | Caproic acid |
| COPD | Chronic obstructive pulmonary disease |

-continued

| | |
|---|---|
| CTL | Cytotoxic T lymphocytes |
| DCC | Dicylcohexylcarbodiimide |
| Dde | 1-(4,4-dimethyl-2,6-dioxo-cyclohexylidene)ethyl |
| ESI-MS | Electron spray ionization mass spectrometry |
| Fmoc | fluorenylmethoxycarbonyl |
| HOBt | 1-Hydroxybenzotriazole |
| HPLC | high performance liquid chromatography |
| HSL | homoserine lactone |
| IB | inclusion bodies |
| KCa | calcium-activated potassium channel (including IKCa, BKCa, SKCa) |
| Kv | voltage-gated potassium channel |
| Lau | Lauric acid |
| LPS | lipopolysaccharide |
| LYMPH | lymphocytes |
| MALDI-MS | Matrix-assisted laser desorption ionization mass spectrometry |
| Me | methyl |
| MeO | methoxy |
| MHC | major histocompatibility complex |
| MMP | matrix metalloproteinase |
| 1-Nap | 1-napthylalanine |
| NEUT | neutrophils |

-continued

| | |
|---|---|
| Nle | norleucine |
| NMP | N-methyl-2-pyrrolidinone |
| PAGE | polyacrylamide gel electrophoresis |
| PBMC | peripheral blood mononuclear cell |
| PBS | Phosphate-buffered saline |
| Pbf | 2,2,4,6,7-pendamethyldihydrobenzofuran-5-sulfonyl |
| PCR | polymerase chain reaction |
| Pec | pipecolic acid |
| PEG | Poly(ethylene glycol) |
| pGlu | pyroglutamic acid |
| Pic | picolinic acid |
| pY | phosphotyrosine |
| RBS | ribosome binding site |
| RT | room temperature (25° C.) |
| Sar | sarcosine |
| SDS | sodium dodecyl sulfate |
| STK | serine-threonine kinases |
| t-Boc | tert-Butoxycarbonyl |
| tBu | tert-Butyl |
| THF | thymic humoral factor |
| Trt | trityl |

SEQUENCE LISTING (5015 sequences)

SEQ ID NO: 1 - DNA, 738 bp, Homo sapiens
  CDS (1)..(738)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 2 - protein, 246 aa, Homo sapiens
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 3 - DNA, 684 bp, Homo sapiens
  CDS (1)..(684)
atggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 4 - protein, 228 aa, Homo sapiens
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 35 aa, Stichodactyla helianthus
RSCIDTIPKSRCTAFQCKHSMKYRLSFCRKTCGTC

SEQ ID NO: 6 - protein, 35 aa, Heteractis magnifica
RTCKDLIPVSECTDIRCRTSMKYRLNLCRKTCGSC

SEQ ID NO: 7 - protein, 36 aa, Actinia equina
GCKDNFSANTCKHVKANNNCGSQKYATNCAKTCGKC

SEQ ID NO: 8 - protein, 36 aa, Anemonia sulcata
ACKDNFAAATCKHVKENKNCGSQKYATNCAKTCGKC

SEQ ID NO: 9 - protein, 37 aa, Bunodosoma granulifera
VCRDWFKETACRHAKSLGNCRTSQKYRANCAKTCELC

SEQ ID NO: 10 - protein, 35 aa, Artificial Sequence; identical to SEQ ID NO: 5
  Definition of Artificial Sequence: Synthetic peptide

SEQ ID NO: 11 - protein, 54 aa, Artificial Sequence
  Definition of Artificial Sequence: Synthetic peptide
MKIFFAILLILAVCSMAIWTVNGTPFAIKCATDADCSRKCPGNPSCRNGFCACT

SEQ ID NO: 12 - protein, 55 aa, Artificial Sequence
  Definition of Artificial Sequence: Synthetic peptide
MKFIIVLILISVLIATIVPVNEAQTQCQSVRDCQQYCLTPDRCSYGTCYCKTTGK

SEQ ID NO: 13 - protein, 35 aa, Artificial Sequence
  Definition of Artificial Sequence: Synthetic peptide
TGPQTTCQAAMCEAGCKGLGKSMESCQGDTCKCKA

SEQ ID NO: 14 - protein, 37 aa, Artificial Sequence
  Definition of Artificial Sequence: Synthetic peptide
DEEPKESCSDEMCVIYCKGEEYSTGVCDGPQKCKCSD

SEQ ID NO: 15 - protein, 56 aa, Artificial Sequence
  Definition of Artificial Sequence: Synthetic peptide
MSRLFTLVLIVLAMNVMMAIISDPVVEAVGCEECPMHCKGKNAKPTCDDGVCNCNV

SEQ ID NO: 16 - protein, 29 aa, Artificial Sequence
  Definition of Artificial Sequence: Synthetic peptide
VSCEDCPEHCSTQKAQAKCDNDKCVCEPI

SEQ ID NO: 17 - protein, 35 aa, Artificial Sequence
  Definition of Artificial Sequence: Synthetic peptide
TISCTNPKQCYPHCKKETGYPNAKCMNRKCKCFGR

SEQ ID NO: 18 - protein, 35 aa, Artificial Sequence
  Definition of Artificial Sequence: Synthetic peptide
TISCTNEKQCYPHCKKETGYPNAKCMNRKCKCFGR

SEQ ID NO: 19 - protein, 38 aa, Artificial Sequence
  Definition of Artificial Sequence: Synthetic peptide
IEAIRCGGSRDCYRPCQKRTGCPNAKCINKTCKCYGCS

SEQ ID NO: 20 - protein, 34 aa, Artificial Sequence
  Definition of Artificial Sequence: Synthetic peptide
VSCTGSKDCYAPCRKQTGCPNAKCINKSCKCYGC

SEQ ID NO: 21 - protein, 35 aa, Artificial Sequence
  Definition of Artificial Sequence: Synthetic peptide
LVKCRGTSDCGRPCQQQTGCPNSKCINRMCKCYGC

SEQ ID NO: 22 - protein, 60 aa, Artificial Sequence
  Definition of Artificial Sequence: Synthetic peptide
MKVFFAVLITLFICSMIIGIHGVGINVKCKHSGQCLKPCKDAGMRFGKCINGKCDCTPKG

SEQ ID NO: 23 - protein, 38 aa, Artificial Sequence
  Definition of Artificial Sequence: Synthetic peptide
GVPINVSCTGSPQCIKPCKDAGMRFGKCMNRKCHCTPK

SEQ ID NO: 24 - protein, 38 aa, Artificial Sequence
  Definition of Artificial Sequence: Synthetic peptide
GVEINVKCSGSPQCLKPCKDAGMRFGKCMNRKCHCTPK

SEQ ID NO: 25 - protein, 38 aa, Artificial Sequence
  Definition of Artificial Sequence: Synthetic peptide
GVIINVKCKISRQCLEPCKKAGMRFGKCMNGKCHCTPK

SEQ ID NO: 26 - protein, 38 aa, Artificial Sequence
  Definition of Artificial Sequence: Synthetic peptide
VGINVKCKHSGQCLKPCKDAGMRFGKCINGKCDCTPKG

SEQ ID NO: 27 - protein, 39 aa, Artificial Sequence
  Definition of Artificial Sequence: Synthetic peptide
TVIDVKCTSPKQCLPPCKAQFGIRAGAKCMNGKCKCYPH

SEQ ID NO: 28 - protein, 39 aa, Artificial Sequence
  Definition of Artificial Sequence: Synthetic peptide
TIINVKCTSPKQCLPPCKAQFGQSAGAKCMNGKCKCYPH

SEQ ID NO: 29 - protein, 38 aa, Artificial Sequence
  Definition of Artificial Sequence: Synthetic peptide
ITINVKCTSPQQCLRPCKDRFGQHAGGKCINGKCKCYP

SEQ ID NO: 30 - protein, 39 aa, Artificial Sequence
  Definition of Artificial Sequence: Synthetic peptide
TIINVKCTSPKQCSKPCKELYGSSAGAKCMNGKCKCYNN

SEQ ID NO: 31 - protein, 37 aa, Artificial Sequence
  Definition of Artificial Sequence: Synthetic peptide
VFINVKCRGSKECLPACKAAVGKAAGKCMNGKCKCYP

SEQ ID NO: 32 - protein, 37 aa, Artificial Sequence
  Definition of Artificial Sequence: Synthetic peptide
VFINAKCRGSPECLPKCKEAIGKAAGKCMNGKCKCYP

SEQ ID NO: 33 - protein, 37 aa, Artificial Sequence
  Definition of Artificial Sequence: Synthetic peptide
EVDMRCKSSKECLVKCKQATGRPNGKCMNRKCKCYPR

SEQ ID NO: 34 - protein, 36 aa, Artificial Sequence
  Definition of Artificial Sequence: Synthetic peptide
GLIDVRCYDSRQCWIACKKVTGSTQGKCQNKQCRCY

SEQ ID NO: 35 - protein, 37 aa, Artificial Sequence
  Definition of Artificial Sequence: Synthetic peptide
FGLIDVKCFASSECWTACKKVTGSGQGKCQNNQCRCY

SEQ ID NO: 36 - protein, 37 aa, Artificial Sequence
  Definition of Artificial Sequence: Synthetic peptide
QFTNVSCTTSKECWSVCQRLHNTSRGKCMNKKCRCYS

SEQ ID NO: 37 - protein, 59 aa, Artificial Sequence
  Definition of Artificial Sequence: Synthetic peptide
MKIFSILLVALIICSISICTEAFGLIDVKCFASSECWTACKKVTGSGQGKCQNNQCRCY

SEQ ID NO: 38 - protein, 37 aa, Artificial Sequence
  Definition of Artificial Sequence: Synthetic peptide
QFTDVDCSVSKECWSVCKDLFGVDRGKCMGKKCRCYQ

SEQ ID NO: 39 - protein, 37 aa, Artificial Sequence
  Definition of Artificial Sequence: Synthetic peptide
TFIDVDCTVSKECWAPCKAAFGVDRGKCMGKKCKCYV

SEQ ID NO: 40 - protein, 37 aa, Artificial Sequence
  Definition of Artificial Sequence: Synthetic peptide
QFTDVKCTGSKQCWPVCKQMFGKPNGKCMNGKCRCYS

SEQ ID NO: 41 - protein, 41 aa, Artificial Sequence
  Definition of Artificial Sequence: Synthetic peptide
WCSTCLDLACGASRECYDPCFKAFGRAHGKCMNNKCRCYTN

SEQ ID NO: 42 - protein, 59 aa, Artificial Sequence
  Definition of Artificial Sequence: Synthetic peptide
MKILSVLLLALIICSIVGWSEAQFTNVSCTTSKECWSVCQRLHNTSRGKCMNKKCRCYS

SEQ ID NO: 43 - protein, 57 aa, Artificial Sequence
  Definition of Artificial Sequence: Synthetic peptide
MKISFLLLALVICSIGWSEAQFTDVKCTGSKQCWPVCKQMFGKPNGKCMNGKCRCYS

SEQ ID NO: 44 - protein, 37 aa, Artificial Sequence
  Definition of Artificial Sequence: Synthetic peptide
QIETNKKCQGGSCASVCRKVIGVAAGKCINGRCVCYP

SEQ ID NO: 45 - protein, 59 aa, Artificial Sequence
  Definition of Artificial Sequence: Synthetic peptide
MKFSSIILLTLLICSMSIFGNCQIETNKKCQGGSCASVCRRVIGVAAGKCINGRCVCYP

SEQ ID NO: 46 - protein, 59 aa, Artificial Sequence
  Definition of Artificial Sequence: Synthetic peptide
MKFSSIILLTLLICSMSKFGNCQVETNVKCQGGSCASVCRKAIGVAAGKCINGRCVCYP

SEQ ID NO: 47 - protein, 35 aa, Artificial Sequence
  Definition of Artificial Sequence: Synthetic peptide
VVIGQRCYRSPDCYSACKKLVGKATGKCTNGRCDC

SEQ ID NO: 48 - protein, 23 aa, Artificial Sequence
  Definition of Artificial Sequence: Synthetic peptide
ACGSCRKKCKGSGKCINGRCKCY

SEQ ID NO: 49 - protein, 28 aa, Artificial Sequence
  Definition of Artificial Sequence: Synthetic peptide
ACGPGCSGSCRQKGDRIKCINGSCHCYP

SEQ ID NO: 50 - protein, 32 aa, Artificial Sequence
  Definition of Artificial Sequence: Synthetic peptide
AVCNLKRCQLSCRSLGLLGKCIGDKCECVKHG

SEQ ID NO: 51 - protein, 31 aa, Artificial Sequence
  Definition of Artificial Sequence: Synthetic peptide
AFCNLRMCQLSCRSLGLLGKCIGDKCECVKH

SEQ ID NO: 52 - protein, 31 aa, Artificial Sequence
  Definition of Artificial Sequence: Synthetic peptide
TVCNLRRCQLSCRSLGLLGKCIGVKCECVKH

SEQ ID NO: 53 - protein, 31 aa, Artificial Sequence
  Definition of Artificial Sequence: Synthetic peptide
AFCNLRRCELSCRSLGLLGKCIGEECKCVPY

SEQ ID NO: 54 - protein, 57 aa, Artificial Sequence
  Definition of Artificial Sequence: Synthetic peptide
MKVLYGILIIFILCSMFYLSQEVVIGQRCYRSPDCYSACKKLVGKATGKCTNGRCDC

SEQ ID NO: 55 - protein, 62 aa, Artificial Sequence
  Definition of Artificial Sequence: Synthetic peptide
MEGIAKITLILLFLFVTMHTFANWNTEAAVCVYRTCDKDCKRRGYRSGKCINNACKCYPYGK

SEQ ID NO: 56 - protein, 35 aa, Artificial Sequence
  Definition of Artificial Sequence: Synthetic peptide
ECRYWLGGCSAGQTCCKHLVCSRRHGWCVWDGTFS

SEQ ID NO: 57 - protein, 31 aa, Artificial Sequence
  Definition of Artificial Sequence: Synthetic peptide
YCQKWMWTCDEERKCCEGLVCRLWCKRIINM

SEQ ID NO: 58 - protein, 34 aa, Artificial Sequence
  Definition of Artificial Sequence: Synthetic peptide
SCIDTIPKSRCTAFQCKHSMKYRLSFCRKTCGTC

SEQ ID NO: 59 - protein, 37 aa, Artificial Sequence
  Definition of Artificial Sequence: Synthetic peptide
QFTNVSCTTSKECWSVCQRLHNTSRGKCMNKECRCYS

SEQ ID NO: 60 - protein, 61 aa, Artificial Sequence
  Definition of Artificial Sequence: Synthetic peptide
MHNYYKIVLIMVAFFAVIITFSNIQVEGAVCNLKRCQLSCRSLGLLGKCIGDKCECVKHGK

SEQ ID NO: 61 - protein, 34 aa, Artificial Sequence
  Definition of Artificial Sequence: Synthetic peptide
ASCRTPKDCADPCRKETGCPYGKCMNRKCKCNRC

SEQ ID NO: 62 - protein, 35 aa, Artificial Sequence
  Definition of Artificial Sequence: Synthetic peptide
ZKECTGPQHCTNFCRKNKCTHGKCMNRKCKCFNCK

SEQ ID NO: 63 - protein, 36 aa, Artificial Sequence
  Definition of Artificial Sequence: Synthetic peptide
RPTDIKCSESYQCFPVCKSRFGKTNGRCVNGFCDCF

SEQ ID NO: 64 - protein, 27 aa, Artificial Sequence
  Definition of Artificial Sequence: Synthetic peptide
CKSPGSSCSPTSYNCCRSCNPYTKRCY

SEQ ID NO: 65 - protein, 25 aa, Artificial Sequence
  Definition of Artificial Sequence: Synthetic peptide
CKGKGAKCSRLMYDCCTGSCRSGKC

SEQ ID NO: 66 - protein, 34 aa, Artificial Sequence
  Definition of Artificial Sequence: Synthetic peptide
AEKDCIAPGAPCFGTDKPCCNPRAWCSSYANKCL

SEQ ID NO: 67 - protein, 36 aa, Artificial Sequence
  Definition of Artificial Sequence: Synthetic peptide
MCMPCFTTDHQMARKCDDCCGGKGRGKCYGPQCLCR

SEQ ID NO: 68 - protein, 19 aa, Artificial Sequence
  Definition of Artificial Sequence: Synthetic peptide
CNCKAPETALCARRCQQHG

SEQ ID NO: 69 - DNA, 720 bp, Artificial Sequence
  Definition of Artificial Sequence: Synthetic construct
  CDS (4)..(702)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggttgagacgctgcaggacgt

SEQ ID NO: 70 - protein, 233 aa, Artificial Sequence
  Definition of Artificial Sequence: Synthetic protein
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGG

SEQ ID NO: 71 - DNA, 687 bp, Artificial Sequence
  Definition of Artificial Sequence: Synthetic construct
  CDS (4)..(687)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 72 - protein, 228 aa, Artificial Sequence; identical to SEQ ID NO: 4
  Definition of Artificial Sequence: Synthetic protein

SEQ ID NO: 73 - DNA, 709 bp, Artificial Sequence
  Definition of Artificial Sequence: Synthetic construct
  CDS (4)..(699)
tcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 74 - protein, 232 aa, Artificial Sequence
  Definition of Artificial Sequence: Synthetic protein
GGGGGDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - DNA, 691 bp, Artificial Sequence
  Definition of Artificial Sequence: Synthetic construct
  CDS (1)..(681)
gacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 76 - protein, 227 aa, Artificial Sequence
  Definition of Artificial Sequence: Synthetic protein
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - DNA, 879 bp, Artificial Sequence
  Definition of Artificial Sequence: Synthetic construct
  CDS (1)..(879)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagccgcagctgcatcgacaccatccccaagagccgctgcaccgccttccagtgcaagcacagcatgaagtaccgcctgagcttctgccgcaagacctgcggcacctgctaatga

SEQ ID NO: 78 - protein, 291 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSRSCIDTIPKSRCTAFQCKHSMKYRLSFCRKTCGTC

SEQ ID NO: 79 - protein, 10 aa, Artificial Sequence
  Definition of Artificial Sequence: Synthetic peptide
GGGGSGGGGS

SEQ ID NO: 80 - DNA, 873 bp, Artificial Sequence
  Definition of Artificial Sequence: Synthetic construct
  CDS (1)..(870)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcagctgcatcgacaccatccccaagagccgctgcaccgccttccagtgcaagcacagcatgaagtaccgcctgagcttctgccgcaagacctgcggcacctgctaa

SEQ ID NO: 81 - protein, 290 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSSCIDTIPKSRCTAFQCKHSMKYRLSFCRKTCGTC

SEQ ID NO: 82 - DNA, 918 bp, Artificial Sequence
  Definition of Artificial Sequence: Synthetic construct
  CDS (1)..(918)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccgggggtgggggttctgggggtgggggttctggaggaggaggaagcggaggaggaggaagcagctgcatcgacaccatccccaagagccgctgcaccgccttccagtgcaagcacagcatgaagtaccgcctgagcttctgccgcaagacctgcggcacctgctaa

SEQ ID NO: 83 - protein, 305 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGGGGSGGGGSGGGGSSCIDTIPKSRCTAFQCKHSMKYRLSFCRKTCGTC

SEQ ID NO: 84 - protein, 25 aa, Artificial Sequence
  Definition of Artificial Sequence: Synthetic peptide
GGGGSGGGGSGGGGSGGGGSGGGGS

SEQ ID NO: 85 - protein, 38 aa, Artificial Sequence
  Definition of Artificial Sequence: Synthetic peptide
GVPINVKCTGSPQCLKPCKDAGMRFGKCINGKCHCTPK

SEQ ID NO: 86 - protein, 37 aa, Artificial Sequence; identical to SEQ ID NO: 32
  Definition of Artificial Sequence: Synthetic peptide

SEQ ID NO: 87 - protein, 37 aa, Artificial Sequence; identical to SEQ ID NO: 31
  Definition of Artificial Sequence: Synthetic peptide

SEQ ID NO: 88 - protein, 35 aa, Artificial Sequence
  Definition of Artificial Sequence: Synthetic peptide
RSCIDTIPKSRCTAFQSKHSMKYRLSFCRKTSGTC

SEQ ID NO: 89 - protein, 35 aa, Artificial Sequence
  Definition of Artificial Sequence: Synthetic peptide
RSSIDTIPKSRCTAFQCKHSMKYRLSFCRKTCGTS

SEQ ID NO: 90 - protein, 35 aa, Artificial Sequence
  Definition of Artificial Sequence: Synthetic peptide
SSCIDTIPKSRCTAFQCKHSMKYRLSFCRKTCGTC

SEQ ID NO: 91 - protein, 35 aa, Artificial Sequence
  Definition of Artificial Sequence: Synthetic peptide
  MOD_RES (1)..(1): N-acetylarginine
XSCIDTIPKSRCTAFQCKHSMKYRLSFCRKTCGTC

SEQ ID NO: 92 - protein, 34 aa, Artificial Sequence; identical to SEQ ID NO: 58
  Definition of Artificial Sequence: Synthetic peptide

SEQ ID NO: 93 - protein, 33 aa, Artificial Sequence
  Definition of Artificial Sequence: Synthetic peptide
CIDTIPKSRCTAFQCKHSMKYRLSFCRKTCGTC

SEQ ID NO: 94 - protein, 35 aa, Artificial Sequence
  Definition of Artificial Sequence: Synthetic peptide
ASCIDTIPKSRCTAFQCKHSMKYRLSFCRKTCGTC

SEQ ID NO: 95 - protein, 35 aa, Artificial Sequence
  Definition of Artificial Sequence: Synthetic peptide
RSCADTIPKSRCTAFQCKHSMKYRLSFCRKTCGTC

SEQ ID NO: 96 - protein, 35 aa, Artificial Sequence
  Definition of Artificial Sequence: Synthetic peptide
RSCADTIPKSRCTAAQCKHSMKYRLSFCRKTCGTC

SEQ ID NO: 97 - protein, 35 aa, Artificial Sequence
  Definition of Artificial Sequence: Synthetic peptide
RSCADTIPKSRCTAAQCKHSMKYRASFCRKTCGTC

SEQ ID NO: 98 - protein, 35 aa, Artificial Sequence
  Definition of Artificial Sequence: Synthetic peptide
RSCIDAIPKSRCTAFQCKHSMKYRLSFCRKTCGTC

SEQ ID NO: 99 - protein, 35 aa, Artificial Sequence
  Definition of Artificial Sequence: Synthetic peptide
RSCIDTAPKSRCTAFQCKHSMKYRLSFCRKTCGTC

SEQ ID NO: 100 - protein, 35 aa, Artificial Sequence
  Definition of Artificial Sequence: Synthetic peptide
RSCIDTIAKSRCTAFQCKHSMKYRLSFCRKTCGTC

SEQ ID NO: 101 - protein, 35 aa, Artificial Sequence
  Definition of Artificial Sequence: Synthetic peptide
RSCIDTIPASRCTAFQCKHSMKYRLSFCRKTCGTC

SEQ ID NO: 102 - protein, 35 aa, Artificial Sequence
  Definition of Artificial Sequence: Synthetic peptide
RSCIDTIPESRCTAFQCKHSMKYRLSFCRKTCGTC

SEQ ID NO: 103 - protein, 35 aa, Artificial Sequence
  Definition of Artificial Sequence: Synthetic peptide
RSCIDTIPQSRCTAFQCKHSMKYRLSFCRKTCGTC

SEQ ID NO: 104 - protein, 35 aa, Artificial Sequence
  Definition of Artificial Sequence: Synthetic peptide
RSCIDTIPKARCTAFQCKHSMKYRLSFCRKTCGTC

SEQ ID NO: 105 - protein, 35 aa, Artificial Sequence
  Definition of Artificial Sequence: Synthetic peptide
RSCIDTIPKSACTAFQCKHSMKYRLSFCRKTCGTC

SEQ ID NO: 106 - protein, 35 aa, Artificial Sequence
  Definition of Artificial Sequence: Synthetic peptide
RSCIDTIPKSECTAFQCKHSMKYRLSFCRKTCGTC

SEQ ID NO: 107 - protein, 35 aa, Artificial Sequence
  Definition of Artificial Sequence: Synthetic peptide
RSCIDTIPKSQCTAFQCKHSMKYRLSFCRKTCGTC

SEQ ID NO: 108 - protein, 35 aa, Artificial Sequence
  Definition of Artificial Sequence: Synthetic peptide
RSCIDTIPKSRCAAFQCKHSMKYRLSFCRKTCGTC

SEQ ID NO: 109 - protein, 35 aa, Artificial Sequence
  Definition of Artificial Sequence: Synthetic peptide
RSCIDTIPKSRCTAAQCKHSMKYRLSFCRKTCGTC

SEQ ID NO: 110 - protein, 35 aa, Artificial Sequence
  Definition of Artificial Sequence: Synthetic peptide
RSCIDTIPKSRCTAWQCKHSMKYRLSFCRKTCGTC

SEQ ID NO: 111 - protein, 35 aa, Artificial Sequence
  Definition of Artificial Sequence: Synthetic peptide
  MOD_RES (15)..(15): Any nonfunctional amino acid residue
RSCIDTIPKSRCTAXQCKHSMKYRLSFCRKTCGTC

SEQ ID NO: 112 - protein, 35 aa, Artificial Sequence
  Definition of Artificial Sequence: Synthetic peptide
RSCIDTIPKSRCTAAQCKHSMKYRASFCRKTCGTC

SEQ ID NO: 113 - protein, 35 aa, Artificial Sequence
  Definition of Artificial Sequence: Synthetic peptide
RSCIDTIPKSRCTAFACKHSMKYRLSFCRKTCGTC

SEQ ID NO: 114 - protein, 35 aa, Artificial Sequence
  Definition of Artificial Sequence: Synthetic peptide
RSCIDTIPKSRCTAFECKHSMKYRLSFCRKTCGTC

SEQ ID NO: 115 - protein, 35 aa, Artificial Sequence
  Definition of Artificial Sequence: Synthetic peptide
RSCIDTIPKSRCTAFQCAHSMKYRLSFCRKTCGTC

SEQ ID NO: 116 - protein, 35 aa, Artificial Sequence
  Definition of Artificial Sequence: Synthetic peptide
RSCIDTIPKSRCTAFQCEHSMKYRLSFCRKTCGTC

SEQ ID NO: 117 - protein, 35 aa, Artificial Sequence
  Definition of Artificial Sequence: Synthetic peptide
RSCIDTIPKSRCTAFQCKASMKYRLSFCRKTCGTC

SEQ ID NO: 118 - protein, 35 aa, Artificial Sequence
  Definition of Artificial Sequence: Synthetic peptide
RSCIDTIPKSRCTAFQCKKSMKYRLSFCRKTCGTC

SEQ ID NO: 119 - protein, 35 aa, Artificial Sequence
  Definition of Artificial Sequence: Synthetic peptide
RSCIDTIPKSRCTAFQCKHAMKYRLSFCRKTCGTC

SEQ ID NO: 120 - protein, 35 aa, Artificial Sequence
  Definition of Artificial Sequence: Synthetic peptide
RSCIDTIPKSRCTAFQCKHSAKYRLSFCRKTCGTC

SEQ ID NO: 121 - protein, 35 aa, Artificial Sequence
  Definition of Artificial Sequence: Synthetic peptide
  MOD_RES (21)..(21): Any nonfunctional amino acid residue
RSCIDTIPKSRCTAFQCKHSXKYRLSFCRKTCGTC

SEQ ID NO: 122 - protein, 35 aa, Artificial Sequence; identical to SEQ ID NO: 121
  Definition of Artificial Sequence: Synthetic peptide
  MOD_RES (21)..(21): Norleucine

SEQ ID NO: 123 - protein, 35 aa, Artificial Sequence
  Definition of Artificial Sequence: Synthetic peptide
RSCIDTIPKSRCTAFQCKHSMAYRLSFCRKTCGTC

SEQ ID NO: 124 - protein, 35 aa, Artificial Sequence
  Definition of Artificial Sequence: Synthetic peptide
RSCIDTIPKSRCTAFQCKHSMEYRLSFCRKTCGTC

SEQ ID NO: 125 - protein, 35 aa, Artificial Sequence
  Definition of Artificial Sequence: Synthetic peptide
RSCIDTIPKSRCTAFQCKHSMRYRLSFCRKTCGTC

SEQ ID NO: 126 - protein, 35 aa, Artificial Sequence
  Definition of Artificial Sequence: Synthetic peptide
  MOD_RES (22)..(22): Any nonfunctional amino acid residue
RSCIDTIPKSRCTAFQCKHSMXYRLSFCRKTCGTC

SEQ ID NO: 127 - protein, 35 aa, Artificial Sequence; identical to SEQ ID NO: 126
  Definition of Artificial Sequence: Synthetic peptide
  MOD_RES (22)..(22): Norleucine

SEQ ID NO: 128 - protein, 35 aa, Artificial Sequence; identical to SEQ ID NO: 126
  Definition of Artificial Sequence: Synthetic peptide
  MOD_RES (22)..(22): Orn

SEQ ID NO: 129 - protein, 35 aa, Artificial Sequence; identical to SEQ ID NO: 126
  Definition of Artificial Sequence: Synthetic peptide
  MOD_RES (22)..(22): hCit

SEQ ID NO: 130 - protein, 35 aa, Artificial Sequence; identical to SEQ ID NO: 126
  Definition of Artificial Sequence: Synthetic peptide
  MOD_RES (22)..(22): Diaminopropionic acid

SEQ ID NO: 131 - protein, 35 aa, Artificial Sequence
  Definition of Artificial Sequence: Synthetic peptide
RSCIDTIPKSRCTAFQCKHSMKARLSFCRKTCGTC

SEQ ID NO: 132 - protein, 35 aa, Artificial Sequence
  Definition of Artificial Sequence: Synthetic peptide
RSCIDTIPKSRCTAFQCKHSMKSRLSFCRKTCGTC

SEQ ID NO: 133 - protein, 35 aa, Artificial Sequence
  Definition of Artificial Sequence: Synthetic peptide
RSCIDTIPKSRCTAFQCKHSMKFRLSFCRKTCGTC

SEQ ID NO: 134 - protein, 35 aa, Artificial Sequence
  Definition of Artificial Sequence: Synthetic peptide
  MOD_RES (23)..(23): Any nonfunctional amino acid residue
RSCIDTIPKSRCTAFQCKHSMKXRLSFCRKTCGTC

SEQ ID NO: 135 - protein, 35 aa, Artificial Sequence; identical to SEQ ID NO: 134
  Definition of Artificial Sequence: Synthetic peptide
  MOD_RES (23)..(23): Nitrophenylalanine

SEQ ID NO: 136 - protein, 35 aa, Artificial Sequence; identical to SEQ ID NO: 134
  Definition of Artificial Sequence: Synthetic peptide
  MOD_RES (23)..(23): Aminophenylalanine

SEQ ID NO: 137 - protein, 35 aa, Artificial Sequence; identical to SEQ ID NO: 134
  Definition of Artificial Sequence: Synthetic peptide
  MOD_RES (23)..(23): Benzoylphenylalanine

SEQ ID NO: 138 - protein, 35 aa, Artificial Sequence
  Definition of Artificial Sequence: Synthetic peptide
RSCIDTIPKSRCTAFQCKHSMKYALSFCRKTCGTC

SEQ ID NO: 139 - protein, 35 aa, Artificial Sequence
  Definition of Artificial Sequence: Synthetic peptide
RSCIDTIPKSRCTAFQCKHSMKYELSFCRKTCGTC

SEQ ID NO: 140 - protein, 35 aa, Artificial Sequence
  Definition of Artificial Sequence: Synthetic peptide
RSCIDTIPKSRCTAFQCKHSMKYRASFCRKTCGTC

SEQ ID NO: 141 - protein, 35 aa, Artificial Sequence
  Definition of Artificial Sequence: Synthetic peptide
RSCIDTIPKSRCTAFQCKHSMKYRLAFCRKTCGTC

SEQ ID NO: 142 - protein, 35 aa, Artificial Sequence
  Definition of Artificial Sequence: Synthetic peptide
RSCIDTIPKSRCTAFQCKHSMKYRLSACRKTCGTC

SEQ ID NO: 143 - protein, 35 aa, Artificial Sequence
  Definition of Artificial Sequence: Synthetic peptide
  MOD_RES (27)..(27): Any nonfunctional amino acid residue
RSCIDTIPKSRCTAFQCKHSMKYRLSXCRKTCGTC

SEQ ID NO: 144 - protein, 35 aa, Artificial Sequence
  Definition of Artificial Sequence: Synthetic peptide
RSCIDTIPKSRCTAFQCKHSMKYRLSFCAKTCGTC

SEQ ID NO: 145 - protein, 35 aa, Artificial Sequence
  Definition of Artificial Sequence: Synthetic peptide
RSCIDTIPKSRCTAFQCKHSMKYRLSFCRATCGTC

SEQ ID NO: 146 - protein, 35 aa, Artificial Sequence
  Definition of Artificial Sequence: Synthetic peptide
RSCIDTIPKSRCTAFQCKHSMKYRLSFCRKACGTC

SEQ ID NO: 147 - protein, 35 aa, Artificial Sequence
  Definition of Artificial Sequence: Synthetic peptide
RSCIDTIPKSRCTAFQCKHSMKYRLSFCRKTCGAC

SEQ ID NO: 148 - protein, 34 aa, Artificial Sequence
  Definition of Artificial Sequence: Synthetic peptide
SCADTIPKSRCTAFQCKHSMKYRLSFCRKTCGTC

SEQ ID NO: 149 - protein, 34 aa, Artificial Sequence
  Definition of Artificial Sequence: Synthetic peptide
SCADTIPKSRCTAAQCKHSMKYRLSFCRKTCGTC

SEQ ID NO: 150 - protein, 34 aa, Artificial Sequence
  Definition of Artificial Sequence: Synthetic peptide
SCADTIPKSRCTAAQCKHSMKYRASFCRKTCGTC

SEQ ID NO: 151 - protein, 34 aa, Artificial Sequence
  Definition of Artificial Sequence: Synthetic peptide
SCIDAIPKSRCTAFQCKHSMKYRLSFCRKTCGTC

SEQ ID NO: 152 - protein, 34 aa, Artificial Sequence
  Definition of Artificial Sequence: Synthetic peptide
SCIDTAPKSRCTAFQCKHSMKYRLSFCRKTCGTC

SEQ ID NO: 153 - protein, 34 aa, Artificial Sequence
  Definition of Artificial Sequence: Synthetic peptide
SCIDTIAKSRCTAFQCKHSMKYRLSFCRKTCGTC

SEQ ID NO: 154 - protein, 34 aa, Artificial Sequence
  Definition of Artificial Sequence: Synthetic peptide
SCIDTIPASRCTAFQCKHSMKYRLSFCRKTCGTC

SEQ ID NO: 155 - protein, 34 aa, Artificial Sequence
  Definition of Artificial Sequence: Synthetic peptide
SCIDTIPESRCTAFQCKHSMKYRLSFCRKTCGTC

SEQ ID NO: 156 - protein, 34 aa, Artificial Sequence
  Definition of Artificial Sequence: Synthetic peptide
SCIDTIPQSRCTAFQCKHSMKYRLSFCRKTCGTC

SEQ ID NO: 157 - protein, 34 aa, Artificial Sequence
  Definition of Artificial Sequence: Synthetic peptide
SCIDTIPKARCTAFQCKHSMKYRLSFCRKTCGTC

SEQ ID NO: 158 - protein, 34 aa, Artificial Sequence
  Definition of Artificial Sequence: Synthetic peptide
SCIDTIPKSACTAFQCKHSMKYRLSFCRKTCGTC

SEQ ID NO: 159 - protein, 34 aa, Artificial Sequence
  Definition of Artificial Sequence: Synthetic peptide
SCIDTIPKSECTAFQCKHSMKYRLSFCRKTCGTC

SEQ ID NO: 160 - protein, 34 aa, Artificial Sequence
  Definition of Artificial Sequence: Synthetic peptide
SCIDTIPKSQCTAFQCKHSMKYRLSFCRKTCGTC

SEQ ID NO: 161 - protein, 34 aa, Artificial Sequence
  Definition of Artificial Sequence: Synthetic peptide
SCIDTIPKSRCAAFQCKHSMKYRLSFCRKTCGTC

SEQ ID NO: 162 - protein, 34 aa, Artificial Sequence
  Definition of Artificial Sequence: Synthetic peptide
SCIDTIPKSRCTAAQCKHSMKYRLSFCRKTCGTC

SEQ ID NO: 163 - protein, 34 aa, Artificial Sequence
  Definition of Artificial Sequence: Synthetic peptide
SCIDTIPKSRCTAWQCKHSMKYRLSFCRKTCGTC

SEQ ID NO: 164 - protein, 34 aa, Artificial Sequence
  Definition of Artificial Sequence: Synthetic peptide
  MOD_RES (14)..(14): Any nonfunctional amino acid residue
SCIDTIPKSRCTAXQCKHSMKYRLSFCRKTCGTC

SEQ ID NO: 165 - protein, 34 aa, Artificial Sequence
  Definition of Artificial Sequence: Synthetic peptide
SCIDTIPKSRCTAAQCKHSMKYRASFCRKTCGTC

SEQ ID NO: 166 - protein, 34 aa, Artificial Sequence
  Definition of Artificial Sequence: Synthetic peptide
SCIDTIPKSRCTAFACKHSMKYRLSFCRKTCGTC

SEQ ID NO: 167 - protein, 34 aa, Artificial Sequence
  Definition of Artificial Sequence: Synthetic peptide
SCIDTIPKSRCTAFECKHSMKYRLSFCRKTCGTC

SEQ ID NO: 168 - protein, 34 aa, Artificial Sequence
  Definition of Artificial Sequence: Synthetic peptide
SCIDTIPKSRCTAFQCAHSMKYRLSFCRKTCGTC

SEQ ID NO: 169 - protein, 34 aa, Artificial Sequence
  Definition of Artificial Sequence: Synthetic peptide
SCIDTIPKSRCTAFQCEHSMKYRLSFCRKTCGTC

SEQ ID NO: 170 - protein, 34 aa, Artificial Sequence
  Definition of Artificial Sequence: Synthetic peptide
SCIDTIPKSRCTAFQCKASMKYRLSFCRKTCGTC

SEQ ID NO: 171 - protein, 34 aa, Artificial Sequence
  Definition of Artificial Sequence: Synthetic peptide
SCIDTIPKSRCTAFQCKKSMKYRLSFCRKTCGTC

SEQ ID NO: 172 - protein, 34 aa, Artificial Sequence
  Definition of Artificial Sequence: Synthetic peptide
SCIDTIPKSRCTAFQCKHAMKYRLSFCRKTCGTC

SEQ ID NO: 173 - protein, 34 aa, Artificial Sequence
  Definition of Artificial Sequence: Synthetic peptide
SCIDTIPKSRCTAFQCKHSAKYRLSFCRKTCGTC

SEQ ID NO: 174 - protein, 34 aa, Artificial Sequence
  Definition of Artificial Sequence: Synthetic peptide
  MOD_RES (20)..(20): Any nonfunctional amino acid residue
SCIDTIPKSRCTAFQCKHSXKYRLSFCRKTCGTC

SEQ ID NO: 175 - protein, 34 aa, Artificial Sequence; identical to SEQ ID NO: 174
  Definition of Artificial Sequence: Synthetic peptide
  MOD_RES (20)..(20): Norleucine

SEQ ID NO: 176 - protein, 34 aa, Artificial Sequence
  Definition of Artificial Sequence: Synthetic peptide
SCIDTIPKSRCTAFQCKHSMAYRLSFCRKTCGTC

SEQ ID NO: 177 - protein, 34 aa, Artificial Sequence
  Definition of Artificial Sequence: Synthetic peptide
SCIDTIPKSRCTAFQCKHSMEYRLSFCRKTCGTC

SEQ ID NO: 178 - protein, 34 aa, Artificial Sequence
  Definition of Artificial Sequence: Synthetic peptide
SCIDTIPKSRCTAFQCKHSMRYRLSFCRKTCGTC

SEQ ID NO: 179 - protein, 34 aa, Artificial Sequence
  Definition of Artificial Sequence: Synthetic peptide
  MOD_RES (21)..(21): Any nonfunctional amino acid residue
SCIDTIPKSRCTAFQCKHSMXYRLSFCRKTCGTC

SEQ ID NO: 180 - protein, 34 aa, Artificial Sequence; identical to SEQ ID NO: 179
  Definition of Artificial Sequence: Synthetic peptide
  MOD_RES (21)..(21): Norleucine

SEQ ID NO: 181 - protein, 34 aa, Artificial Sequence; identical to SEQ ID NO: 179
  Definition of Artificial Sequence: Synthetic peptide
  MOD_RES (21)..(21): Orn

SEQ ID NO: 182 - protein, 34 aa, Artificial Sequence; identical to SEQ ID NO: 179
  Definition of Artificial Sequence: Synthetic peptide
  MOD_RES (21)..(21): hCit

SEQ ID NO: 183 - protein, 34 aa, Artificial Sequence; identical to SEQ ID NO: 179
  Definition of Artificial Sequence: Synthetic peptide
  MOD_RES (21)..(21): Diaminopropionic acid

SEQ ID NO: 184 - protein, 34 aa, Artificial Sequence
  Definition of Artificial Sequence: Synthetic peptide
SCIDTIPKSRCTAFQCKHSMKARLSFCRKTCGTC

SEQ ID NO: 185 - protein, 34 aa, Artificial Sequence
  Definition of Artificial Sequence: Synthetic peptide
SCIDTIPKSRCTAFQCKHSMKSRLSFCRKTCGTC

SEQ ID NO: 186 - protein, 34 aa, Artificial Sequence
  Definition of Artificial Sequence: Synthetic peptide
SCIDTIPKSRCTAFQCKHSMKFRLSFCRKTCGTC

SEQ ID NO: 187 - protein, 34 aa, Artificial Sequence
  Definition of Artificial Sequence: Synthetic peptide
  MOD_RES (22)..(22): Any nonfunctional amino acid residue
SCIDTIPKSRCTAFQCKHSMKXRLSFCRKTCGTC

SEQ ID NO: 188 - protein, 34 aa, Artificial Sequence; identical to SEQ ID NO: 187
  Definition of Artificial Sequence: Synthetic peptide
  MOD_RES (22)..(22): Nitrophenaylalanine

SEQ ID NO: 189 - protein, 34 aa, Artificial Sequence; identical to SEQ ID NO: 187
  Definition of Artificial Sequence: Synthetic peptide
  MOD_RES (22)..(22): Aminophenylalanine

SEQ ID NO: 190 - protein, 34 aa, Artificial Sequence; identical to SEQ ID NO: 187
  Definition of Artificial Sequence: Synthetic peptide
  MOD_RES (22)..(22): Benzoylphenylalanine

SEQ ID NO: 191 - protein, 34 aa, Artificial Sequence
  Definition of Artificial Sequence: Synthetic peptide
SCIDTIPKSRCTAFQCKHSMKYALSFCRKTCGTC

SEQ ID NO: 192 - protein, 34 aa, Artificial Sequence
  Definition of Artificial Sequence: Synthetic peptide
SCIDTIPKSRCTAFQCKHSMKYELSFCRKTCGTC

SEQ ID NO: 193 - protein, 34 aa, Artificial Sequence
  Definition of Artificial Sequence: Synthetic peptide
SCIDTIPKSRCTAFQCKHSMKYRASFCRKTCGTC

SEQ ID NO: 194 - protein, 34 aa, Artificial Sequence
  Definition of Artificial Sequence: Synthetic peptide
SCIDTIPKSRCTAFQCKHSMKYRLAFCRKTCGTC

SEQ ID NO: 195 - protein, 34 aa, Artificial Sequence
  Definition of Artificial Sequence: Synthetic peptide
SCIDTIPKSRCTAFQCKHSMKYRLSACRKTCGTC

SEQ ID NO: 196 - protein, 34 aa, Artificial Sequence
  Definition of Artificial Sequence: Synthetic peptide
  MOD_RES (26)..(26): Any nonfunctional amino acid residue
SCIDTIPKSRCTAFQCKHSMKYRLSXCRKTCGTC

SEQ ID NO: 197 - protein, 34 aa, Artificial Sequence
  Definition of Artificial Sequence: Synthetic peptide
SCIDTIPKSRCTAFQCKHSMKYRLSFCAKTCGTC

SEQ ID NO: 198 - protein, 34 aa, Artificial Sequence
  Definition of Artificial Sequence: Synthetic peptide
SCIDTIPKSRCTAFQCKHSMKYRLSFCRATCGTC

SEQ ID NO: 199 - protein, 34 aa, Artificial Sequence
  Definition of Artificial Sequence: Synthetic peptide
SCIDTIPKSRCTAFQCKHSMKYRLSFCRKACGTC

SEQ ID NO: 200 - protein, 34 aa, Artificial Sequence
  Definition of Artificial Sequence: Synthetic peptide
SCIDTIPKSRCTAFQCKHSMKYRLSFCRKTCGAC

SEQ ID NO: 201 - protein, 35 aa, Artificial Sequence
  Definition of Artificial Sequence: Synthetic peptide
ATCKDLIPVSECTDIRCRTSMKYRLNLCRKTCGSC

SEQ ID NO: 202 - protein, 35 aa, Artificial Sequence
  Definition of Artificial Sequence: Synthetic peptide
STCKDLIPVSECTDIRCRTSMKYRLNLCRKTCGSC

SEQ ID NO: 203 - protein, 34 aa, Artificial Sequence
  Definition of Artificial Sequence: Synthetic peptide
TCKDLIPVSECTDIRCRTSMKYRLNLCRKTCGSC

SEQ ID NO: 204 - protein, 34 aa, Artificial Sequence
  Definition of Artificial Sequence: Synthetic peptide
SCKDLIPVSECTDIRCRTSMKYRLNLCRKTCGSC

SEQ ID NO: 205 - protein, 34 aa, Artificial Sequence
  Definition of Artificial Sequence: Synthetic peptide
TCIDLIPVSECTDIRCRTSMKYRLNLCRKTCGSC

SEQ ID NO: 206 - protein, 34 aa, Artificial Sequence
  Definition of Artificial Sequence: Synthetic peptide
TCKDTIPVSECTDIRCRTSMKYRLNLCRKTCGSC

SEQ ID NO: 207 - protein, 34 aa, Artificial Sequence
  Definition of Artificial Sequence: Synthetic peptide
TCKDLIPKSECTDIRCRTSMKYRLNLCRKTCGSC

SEQ ID NO: 208 - protein, 34 aa, Artificial Sequence
  Definition of Artificial Sequence: Synthetic peptide
TCKDLIPVSRCTDIRCRTSMKYRLNLCRKTCGSC

SEQ ID NO: 209 - protein, 34 aa, Artificial Sequence
  Definition of Artificial Sequence: Synthetic peptide
TCKDLIPVSECTAIRCRTSMKYRLNLCRKTCGSC

SEQ ID NO: 210 - protein, 34 aa, Artificial Sequence
  Definition of Artificial Sequence: Synthetic peptide
TCKDLIPVSECTDFRCRTSMKYRLNLCRKTCGSC

SEQ ID NO: 211 - protein, 34 aa, Artificial Sequence
  Definition of Artificial Sequence: Synthetic peptide
TCKDLIPVSECTDIQCRTSMKYRLNLCRKTCGSC

SEQ ID NO: 212 - protein, 34 aa, Artificial Sequence
  Definition of Artificial Sequence: Synthetic peptide
TCKDLIPVSECTDIRCKTSMKYRLNLCRKTCGSC

SEQ ID NO: 213 - protein, 34 aa, Artificial Sequence
  Definition of Artificial Sequence: Synthetic peptide
TCKDLIPVSECTDIRCRHSMKYRLNLCRKTCGSC

SEQ ID NO: 214 - protein, 34 aa, Artificial Sequence
  Definition of Artificial Sequence: Synthetic peptide
TCKDLIPVSECTDIRCRTSMKYRLSLCRKTCGSC

SEQ ID NO: 215 - protein, 34 aa, Artificial Sequence
  Definition of Artificial Sequence: Synthetic peptide
TCKDLIPVSECTDIRCRTSMKYRLNFCRKTCGSC

SEQ ID NO: 216 - protein, 34 aa, Artificial Sequence
  Definition of Artificial Sequence: Synthetic peptide
TCKDLIPVSECTDIRCRTSMKYRLNLCRKTCGTC

SEQ ID NO: 217 - protein, 34 aa, Artificial Sequence
  Definition of Artificial Sequence: Synthetic peptide
TCKDLIPVSRCTDIRCRTSMKYRLNFCRKTCGSC

SEQ ID NO: 218 - protein, 35 aa, Artificial Sequence
  Definition of Artificial Sequence: Synthetic peptide
ATCKDLIPVSRCTDIRCRTSMKYRLNFCRKTCGSC

SEQ ID NO: 219 - protein, 34 aa, Artificial Sequence
  Definition of Artificial Sequence: Synthetic peptide
TCIDTIPKSRCTAFQCKHSMKYRLSFCRKTCGSC

SEQ ID NO: 220 - protein, 34 aa, Artificial Sequence
  Definition of Artificial Sequence: Synthetic peptide
TCIDTIPKSRCTAFQCRTSMKYRLNFCRKTCGSC

SEQ ID NO: 221 - protein, 34 aa, Artificial Sequence
  Definition of Artificial Sequence: Synthetic peptide
TCADLIPASRCTAIACRTSMKYRLNFCRKTCGSC

SEQ ID NO: 222 - protein, 34 aa, Artificial Sequence
  Definition of Artificial Sequence: Synthetic peptide
TCADLIPASRCTAIACKHSMKYRLNFCRKTCGSC

SEQ ID NO: 223 - protein, 34 aa, Artificial Sequence
  Definition of Artificial Sequence: Synthetic peptide
TCADLIPASRCTAIACAHSMKYRLNFCRKTCGSC

SEQ ID NO: 224 - protein, 35 aa, Artificial Sequence
  Definition of Artificial Sequence: Synthetic peptide
  MOD_RES (22)..(22): Any nonfunctional amino acid residue
RTCKDLIPVSECTDIRCRTSMXYRLNLCRKTCGSC

SEQ ID NO: 225 - protein, 35 aa, Artificial Sequence
  Definition of Artificial Sequence: Synthetic peptide
  MOD_RES (7)..(7): Any nonfunctional amino acid residue
  MOD_RES (23)..(23): Any nonfunctional amino acid residue
  MOD_RES (27)..(27): Any nonfunctional amino acid residue
ATCKDLXPVSRCTDIRCRTSMKXRLNXCRKTCGSC

SEQ ID NO: 226 - protein, 37 aa, Artificial Sequence
  Definition of Artificial Sequence: Synthetic peptide
ACRDWFKETACRHAKSLGNCRTSQKYRANCAKTCELC

SEQ ID NO: 227 - protein, 37 aa, Artificial Sequence
  Definition of Artificial Sequence: Synthetic peptide
VCADWFKETACRHAKSLGNCRTSQKYRANCAKTCELC

SEQ ID NO: 228 - protein, 37 aa, Artificial Sequence
  Definition of Artificial Sequence: Synthetic peptide
VCRDAFKETACRHAKSLGNCRTSQKYRANCAKTCELC

SEQ ID NO: 229 - protein, 37 aa, Artificial Sequence
  Definition of Artificial Sequence: Synthetic peptide
VCRDWFKATACRHAKSLGNCRTSQKYRANCAKTCELC

SEQ ID NO: 230 - protein, 37 aa, Artificial Sequence
  Definition of Artificial Sequence: Synthetic peptide
VCRDWFKEAACRHAKSLGNCRTSQKYRANCAKTCELC

SEQ ID NO: 231 - protein, 37 aa, Artificial Sequence
  Definition of Artificial Sequence: Synthetic peptide
VCRDWFKETACAHAKSLGNCRTSQKYRANCAKTCELC

SEQ ID NO: 232 - protein, 37 aa, Artificial Sequence
  Definition of Artificial Sequence: Synthetic peptide
VCRDWFKETACRHAASLGNCRTSQKYRANCAKTCELC

SEQ ID NO: 233 - protein, 37 aa, Artificial Sequence
  Definition of Artificial Sequence: Synthetic peptide
VCRDWFKETACRHAKALGNCRTSQKYRANCAKTCELC

SEQ ID NO: 234 - protein, 37 aa, Artificial Sequence
  Definition of Artificial Sequence: Synthetic peptide
VCRDWFKETACRHAKSAGNCRTSQKYRANCAKTCELC

SEQ ID NO: 235 - protein, 37 aa, Artificial Sequence
  Definition of Artificial Sequence: Synthetic peptide
VCRDWFKETACRHAKSLGNCATSQKYRANCAKTCELC

SEQ ID NO: 236 - protein, 37 aa, Artificial Sequence
  Definition of Artificial Sequence: Synthetic peptide
VCRDWFKETACRHAKSLGNCRASQKYRANCAKTCELC

SEQ ID NO: 237 - protein, 37 aa, Artificial Sequence
  Definition of Artificial Sequence: Synthetic peptide
VCRDWFKETACRHAKSLGNCRTSQKYAANCAKTCELC

SEQ ID NO: 238 - protein, 37 aa, Artificial Sequence
  Definition of Artificial Sequence: Synthetic peptide
VCRDWFKETACRHAKSLGNCRTSQKYRANCAATCELC

SEQ ID NO: 239 - protein, 37 aa, Artificial Sequence
  Definition of Artificial Sequence: Synthetic peptide
VCRDWFKETACRHAKSLGNCRTSQKYRANCAKACELC

SEQ ID NO: 240 - protein, 37 aa, Artificial Sequence
  Definition of Artificial Sequence: Synthetic peptide
VCRDWFKETACRHAKSLGNCRTSQKYRANCAKTCALC

SEQ ID NO: 241 - protein, 37 aa, Artificial Sequence
  Definition of Artificial Sequence: Synthetic peptide
VCRDWFKETACRHAKSLGNCRTSQKYRANCAKTCEAC

SEQ ID NO: 242 - protein, 39 aa, Artificial Sequence
  Definition of Artificial Sequence: Synthetic peptide
TIINVACTSPKQCLPPCKAQFGQSAGAKCMNGKCKCYPH

SEQ ID NO: 243 - protein, 39 aa, Artificial Sequence
  Definition of Artificial Sequence: Synthetic peptide
TIINVSCTSPKQCLPPCKAQFGQSAGAKCMNGKCKCYPH

SEQ ID NO: 244 - protein, 39 aa, Artificial Sequence
  Definition of Artificial Sequence: Synthetic peptide
TIINVKCTSPAQCLPPCKAQFGQSAGAKCMNGKCKCYPH

SEQ ID NO: 245 - protein, 39 aa, Artificial Sequence
  Definition of Artificial Sequence: Synthetic peptide
TIINVKCTSPKQCLPPCAAQFGQSAGAKCMNGKCKCYPH

SEQ ID NO: 246 - protein, 39 aa, Artificial Sequence
  Definition of Artificial Sequence: Synthetic peptide
TIINVKCTSPKQCLPPCKAQFGQSAGAACMNGKCKCYPH

SEQ ID NO: 247 - protein, 39 aa, Artificial Sequence
  Definition of Artificial Sequence: Synthetic peptide
TIINVKCTSPKQCLPPCKAQFGQSAGAKCMNGACKCYPH

SEQ ID NO: 248 - protein, 39 aa, Artificial Sequence
  Definition of Artificial Sequence: Synthetic peptide
TIINVKCTSPKQCLPPCKAQFGQSAGAKCMNGKCACYPH

SEQ ID NO: 249 - protein, 39 aa, Artificial Sequence
  Definition of Artificial Sequence: Synthetic peptide
TIINVKCTSPKQCLPPCKAQFGQSAGAKCMNGKCKCYPN

SEQ ID NO: 250 - protein, 39 aa, Artificial Sequence
  Definition of Artificial Sequence: Synthetic peptide
TIINVACTSPKQCLPPCKAQFGQSAGAKCMNGKCKCYPN

SEQ ID NO: 251 - protein, 38 aa, Artificial Sequence
  Definition of Artificial Sequence: Synthetic peptide
TIINVSCTSPKQCLPPCKAQFGQSAGAKCMNGKCKCYS

SEQ ID NO: 252 - protein, 39 aa, Artificial Sequence
  Definition of Artificial Sequence: Synthetic peptide
TIITISCTSPKQCLPPCKAQFGQSAGAKCMNGKCKCYPH

SEQ ID NO: 253 - protein, 36 aa, Artificial Sequence
  Definition of Artificial Sequence: Synthetic peptide
TISCTSPKQCLPPCKAQFGQSAGAKCMNGKCKCYPH

SEQ ID NO: 254 - protein, 36 aa, Artificial Sequence
  Definition of Artificial Sequence: Synthetic peptide
TISCTSPKQCLPPCKAQFGQSAGAKCMNGKCKCFGR

SEQ ID NO: 255 - protein, 36 aa, Artificial Sequence
  Definition of Artificial Sequence: Synthetic peptide
NVACTSPKQCLPPCKAQFGQSAGAKCMNGKCKCYPH

SEQ ID NO: 256 - protein, 38 aa, Artificial Sequence
  Definition of Artificial Sequence: Synthetic peptide
QFTNVSCTSPKQCLPPCKAQFGQSAGAKCMNGKCKCYS

SEQ ID NO: 257 - protein, 38 aa, Artificial Sequence
  Definition of Artificial Sequence: Synthetic peptide
QFTDVDCTSPKQCLPPCKAQFGQSAGAKCMNGKCKCYQ

SEQ ID NO: 258 - protein, 38 aa, Artificial Sequence
  Definition of Artificial Sequence: Synthetic peptide
IINVSCTSPKQCLPPCKAQFGQSAGAKCMNGKCKCYPH

SEQ ID NO: 259 - protein, 38 aa, Artificial Sequence
  Definition of Artificial Sequence: Synthetic peptide
IITISCTSPKQCLPPCKAQFGQSAGAKCMNGKCKCYPH

SEQ ID NO: 260 - protein, 40 aa, Artificial Sequence
  Definition of Artificial Sequence: Synthetic peptide
GVIINVSCTSPKQCLPPCKAQFGQSAGAKCMNGKCKCYPH

SEQ ID NO: 261 - protein, 38 aa, Artificial Sequence
  Definition of Artificial Sequence: Synthetic peptide
GVPIAVSCTGSPQCIKPCKDAGMRFGKCMNRKCHCTPK

SEQ ID NO: 262 - protein, 38 aa, Artificial Sequence
  Definition of Artificial Sequence: Synthetic peptide
GVPINVSCTGSPQCIAPCKDAGMRFGKCMNRKCHCTPK

SEQ ID NO: 263 - protein, 38 aa, Artificial Sequence
  Definition of Artificial Sequence: Synthetic peptide
GVPINVSCTGSPQCIKPCADAGMRFGKCMNRKCHCTPK

SEQ ID NO: 264 - protein, 38 aa, Artificial Sequence
  Definition of Artificial Sequence: Synthetic peptide
GVPINVSCTGSPQCIKPCKDAGMAFGKCMNRKCHCTPK

SEQ ID NO: 265 - protein, 38 aa, Artificial Sequence
  Definition of Artificial Sequence: Synthetic peptide
GVPINVSCTGSPQCIKPCKDAGMRFGACMNRKCHCTPK

SEQ ID NO: 266 - protein, 38 aa, Artificial Sequence
  Definition of Artificial Sequence: Synthetic peptide
GVPINVSCTGSPQCIKPCKDAGMRFGKCMNAKCHCTPK

SEQ ID NO: 267 - protein, 38 aa, Artificial Sequence
  Definition of Artificial Sequence: Synthetic peptide
GVPINVSCTGSPQCIKPCKDAGMRFGKCMNRACHCTPK

SEQ ID NO: 268 - protein, 38 aa, Artificial Sequence
  Definition of Artificial Sequence: Synthetic peptide
GVPINVSCTGSPQCIKPCKDAGMRFGKCMNRKCHCTPA

SEQ ID NO: 269 - protein, 38 aa, Artificial Sequence
  Definition of Artificial Sequence: Synthetic peptide
GVPIAVSCTGSPQCIKPCKDAGMRFGKCMNRKCHCTPA

SEQ ID NO: 270 - protein, 38 aa, Artificial Sequence
  Definition of Artificial Sequence: Synthetic peptide
GVPINVSCTGSPQCIKPCKDAGMRFGKCMNGKCHCTPK

SEQ ID NO: 271 - protein, 38 aa, Artificial Sequence
  Definition of Artificial Sequence: Synthetic peptide
GVPIIVSCKGSRQCIKPCKDAGMRFGKCMNGKCHCTPK

SEQ ID NO: 272 - protein, 38 aa, Artificial Sequence
  Definition of Artificial Sequence: Synthetic peptide
GVPIIVSCKISRQCIKPCKDAGMRFGKCMNGKCHCTPK

SEQ ID NO: 273 - protein, 38 aa, Artificial Sequence
  Definition of Artificial Sequence: Synthetic peptide
GVPIIVKCKGSRQCIKPCKDAGMRFGKCMNGKCHCTPK

SEQ ID NO: 274 - protein, 38 aa, Artificial Sequence
  Definition of Artificial Sequence: Synthetic peptide
GVPIIVKCKISRQCIKPCKDAGMRFGKCMNGKCHCTPK

SEQ ID NO: 275 - protein, 38 aa, Artificial Sequence; identical to SEQ ID NO: 274
  Definition of Artificial Sequence: Synthetic peptide

SEQ ID NO: 276 - protein, 34 aa, Artificial Sequence
  Definition of Artificial Sequence: Synthetic peptide
  MOD_RES (4)..(4): variable amino acid
ASCXTPKDCADPCRKETGCPYGKCMNRKCKCNRC

SEQ ID NO: 277 - protein, 34 aa, Artificial Sequence
  Definition of Artificial Sequence: Synthetic peptide
ASCATPKDCADPCRKETGCPYGKCMNRKCKCNRC

SEQ ID NO: 278 - protein, 34 aa, Artificial Sequence
  Definition of Artificial Sequence: Synthetic peptide
  MOD_RES (7)..(7): variable amino acid
ASCRTPXDCADPCRKETGCPYGKCMNRKCKCNRC

SEQ ID NO: 279 - protein, 34 aa, Artificial Sequence
  Definition of Artificial Sequence: Synthetic peptide
ASCRTPADCADPCRKETGCPYGKCMNRKCKCNRC

SEQ ID NO: 280 - protein, 34 aa, Artificial Sequence
  Definition of Artificial Sequence: Synthetic peptide
  MOD_RES (14)..(14): variable amino acid
ASCRTPKDCADPCXKETGCPYGKCMNRKCKCNRC

SEQ ID NO: 281 - protein, 34 aa, Artificial Sequence
  Definition of Artificial Sequence: Synthetic peptide
ASCRTPKDCADPCAKETGCPYGKCMNRKCKCNRC

SEQ ID NO: 282 - protein, 34 aa, Artificial Sequence
  Definition of Artificial Sequence: Synthetic peptide
  MOD_RES (15)..(15): variable amino acid
ASCRTPKDCADPCRXETGCPYGKCMNRKCKCNRC

SEQ ID NO: 283 - protein, 34 aa, Artificial Sequence
  Definition of Artificial Sequence: Synthetic peptide
ASCRTPKDCADPCRAETGCPYGKCMNRKCKCNRC

SEQ ID NO: 284 - protein, 34 aa, Artificial Sequence
  Definition of Artificial Sequence: Synthetic peptide
  MOD_RES (23)..(23): variable amino acid
ASCRTPKDCADPCRKETGCPYGXCMNRKCKCNRC

SEQ ID NO: 285 - protein, 34 aa, Artificial Sequence
  Definition of Artificial Sequence: Synthetic peptide
ASCRTPKDCADPCRKETGCPYGACMNRKCKCNRC

SEQ ID NO: 286 - protein, 34 aa, Artificial Sequence
  Definition of Artificial Sequence: Synthetic peptide
  MOD_RES (27)..(27): variable amino acid
ASCRTPKDCADPCRKETGCPYGKCMNXKCKCNRC

SEQ ID NO: 287 - protein, 34 aa, Artificial Sequence
  Definition of Artificial Sequence: Synthetic peptide
ASCRTPKDCADPCRKETGCPYGKCMNAKCKCNRC

SEQ ID NO: 288 - protein, 34 aa, Artificial Sequence
  Definition of Artificial Sequence: Synthetic peptide
  MOD_RES (28)..(28): variable amino acid
ASCRTPKDCADPCRKETGCPYGKCMNRXCKCNRC

SEQ ID NO: 289 - protein, 34 aa, Artificial Sequence
  Definition of Artificial Sequence: Synthetic peptide
ASCRTPKDCADPCRKETGCPYGKCMNRACKCNRC

SEQ ID NO: 290 - protein, 34 aa, Artificial Sequence
  Definition of Artificial Sequence: Synthetic peptide
  MOD_RES (30)..(30): variable amino acid
ASCRTPKDCADPCRKETGCPYGKCMNRKCXCNRC

SEQ ID NO: 291 - protein, 34 aa, Artificial Sequence
  Definition of Artificial Sequence: Synthetic peptide
ASCRTPKDCADPCRKETGCPYGKCMNRKCACNRC

SEQ ID NO: 292 - protein, 34 aa, Artificial Sequence
  Definition of Artificial Sequence: Synthetic peptide
  MOD_RES (33)..(33): variable amino acid
ASCRTPKDCADPCRKETGCPYGKCMNRKCKCNXC

SEQ ID NO: 293 - protein, 34 aa, Artificial Sequence
  Definition of Artificial Sequence: Synthetic peptide
ASCRTPKDCADPCRKETGCPYGKCMNRKCKCNAC

SEQ ID NO: 294 - protein, 38 aa, Artificial Sequence
  Definition of Artificial Sequence: Synthetic peptide
GVIINVKCKISRQCLKPCKKAGMRFGKCMNGKCHCTPK

SEQ ID NO: 295 - protein, 38 aa, Artificial Sequence
  Definition of Artificial Sequence: Synthetic peptide
GVIINVKCKISRQCLEPCKDAGMRFGKCMNGKCHCTPK

SEQ ID NO: 296 - protein, 38 aa, Artificial Sequence
  Definition of Artificial Sequence: Synthetic peptide
GVIINVKCKISRQCLKPCKDAGMRFGKCMNGKCHCTPK

SEQ ID NO: 297 - protein, 38 aa, Artificial Sequence
  Definition of Artificial Sequence: Synthetic peptide
GVIINVKCKISPQCLKPCKDAGMRFGKCMNGKCHCTPK

SEQ ID NO: 298 - protein, 38 aa, Artificial Sequence
  Definition of Artificial Sequence: Synthetic peptide
GVIINVKCKISRQCLKPCKDAGMRFGKCMNGKCHCYPK

SEQ ID NO: 299 - protein, 35 aa, Artificial Sequence
  Definition of Artificial Sequence: Synthetic peptide
  MOD_RES (8)..(8): variable amino acid
TISCTNPXQCYPHCKKETGYPNAKCMNRKCKCFGR

SEQ ID NO: 300 - protein, 35 aa, Artificial Sequence
  Definition of Artificial Sequence: Synthetic peptide
TISCTNPAQCYPHCKKETGYPNAKCMNRKCKCFGR

SEQ ID NO: 301 - protein, 35 aa, Artificial Sequence
  Definition of Artificial Sequence: Synthetic peptide
  MOD_RES (15)..(15): variable amino acid
TISCTNPKQCYPHCXKETGYPNAKCMNRKCKCFGR

SEQ ID NO: 302 - protein, 35 aa, Artificial Sequence
  Definition of Artificial Sequence: Synthetic peptide
TISCTNPKQCYPHCAKETGYPNAKCMNRKCKCFGR

SEQ ID NO: 303 - protein, 35 aa, Artificial Sequence
  Definition of Artificial Sequence: Synthetic peptide
  MOD_RES (16)..(16): variable amino acid
TISCTNPKQCYPHCKXETGYPNAKCMNRKCKCFGR

SEQ ID NO: 304 - protein, 35 aa, Artificial Sequence
  Definition of Artificial Sequence: Synthetic peptide
TISCTNPKQCYPHCKAETGYPNAKCMNRKCKCFGR

SEQ ID NO: 305 - protein, 35 aa, Artificial Sequence
  Definition of Artificial Sequence: Synthetic peptide
  MOD_RES (24)..(24): variable amino acid
TISCTNPKQCYPHCKKETGYPNAXCMNRKCKCFGR

SEQ ID NO: 306 - protein, 35 aa, Artificial Sequence
  Definition of Artificial Sequence: Synthetic peptide
TISCTNPKQCYPHCKKETGYPNAACMNRKCKCFGR

SEQ ID NO: 307 - protein, 35 aa, Artificial Sequence
  Definition of Artificial Sequence: Synthetic peptide
  MOD_RES (28)..(28): variable amino acid
TISCTNPKQCYPHCKKETGYPNAKCMNXKCKCFGR

SEQ ID NO: 308 - protein, 35 aa, Artificial Sequence
  Definition of Artificial Sequence: Synthetic peptide
TISCTNPKQCYPHCKKETGYPNAKCMNAKCKCFGR

SEQ ID NO: 309 - protein, 35 aa, Artificial Sequence
  Definition of Artificial Sequence: Synthetic peptide
  MOD_RES (29)..(29): variable amino acid
TISCTNPKQCYPHCKKETGYPNAKCMNRXCKCFGR

SEQ ID NO: 310 - protein, 35 aa, Artificial Sequence
  Definition of Artificial Sequence: Synthetic peptide
TISCTNPKQCYPHCKKETGYPNAKCMNRACKCFGR

SEQ ID NO: 311 - protein, 35 aa, Artificial Sequence
  Definition of Artificial Sequence: Synthetic peptide
  MOD_RES (31)..(31): variable amino acid
TISCTNPKQCYPHCKKETGYPNAKCMNRKCXCFGR

SEQ ID NO: 312 - protein, 35 aa, Artificial Sequence
  Definition of Artificial Sequence: Synthetic peptide
TISCTNPKQCYPHCKKETGYPNAKCMNRKCACFGR

SEQ ID NO: 313 - protein, 35 aa, Artificial Sequence
  Definition of Artificial Sequence: Synthetic peptide
  MOD_RES (35)..(35): variable amino acid
TISCTNPKQCYPHCKKETGYPNAKCMNRKCKCFGX

SEQ ID NO: 314 - protein, 35 aa, Artificial Sequence
  Definition of Artificial Sequence: Synthetic peptide
TISCTNPKQCYPHCKKETGYPNAKCMNRKCKCFGA

SEQ ID NO: 315 - protein, 34 aa, Artificial Sequence
  Definition of Artificial Sequence: Synthetic peptide
TISCTNPKQCYPHCKKETGYPNAKCMNRKCKCFG

SEQ ID NO: 316 - protein, 34 aa, Artificial Sequence
  Definition of Artificial Sequence: Synthetic peptide
KECTGPQHCTNFCRKNKCTHGKCMNRKCKCFNCK

SEQ ID NO: 317 - protein, 34 aa, Artificial Sequence
  Definition of Artificial Sequence: Synthetic peptide
  MOD_RES (1)..(1): variable amino acid
XECTGPQHCTNFCRKNKCTHGKCMNRKCKCFNCK

SEQ ID NO: 318 - protein, 34 aa, Artificial Sequence
  Definition of Artificial Sequence: Synthetic peptide
AECTGPQHCTNFCRKNKCTHGKCMNRKCKCFNCK

SEQ ID NO: 319 - protein, 39 aa, Artificial Sequence
  Definition of Artificial Sequence: Synthetic peptide
TIINVACTSPKQCSKPCKELYGSSAGAKCMNGKCKCYNN

SEQ ID NO: 320 - protein, 39 aa, Artificial Sequence
  Definition of Artificial Sequence: Synthetic peptide
TIINVKCTSPKQCSKPCKELYGSSRGAKCMNGKCKCYNN

SEQ ID NO: 321 - protein, 39 aa, Artificial Sequence
  Definition of Artificial Sequence: Synthetic peptide
TIINVKCTSSKQCSKPCKELYGSSAGAKCMNGKCKCYNN

SEQ ID NO: 322 - protein, 39 aa, Artificial Sequence
  Definition of Artificial Sequence: Synthetic peptide
TIINVKCTSPKQCWKPCKELYGSSAGAKCMNGKCKCYNN

SEQ ID NO: 323 - protein, 38 aa, Artificial Sequence
  Definition of Artificial Sequence: Synthetic peptide
TIINVKCTSPKQCSKPCKELYGSSGAKCMNGKCKCYNN

SEQ ID NO: 324 - protein, 38 aa, Artificial Sequence
  Definition of Artificial Sequence: Synthetic peptide
TIINVKCTSPKQCSKPCKELFGVDRGKCMNGKCKCYNN

SEQ ID NO: 325 - protein, 37 aa, Artificial Sequence
  Definition of Artificial Sequence: Synthetic peptide
TIINVKCTSPKQCWKPCKELFGVDRGKCMNGKCKCYN

SEQ ID NO: 326 - protein, 37 aa, Artificial Sequence
  Definition of Artificial Sequence: Synthetic peptide
VRIPVSCKHSGQCLKPCKDAGMRFGKCMNGKCDCTPK

SEQ ID NO: 327 - protein, 38 aa, Artificial Sequence
  Definition of Artificial Sequence: Synthetic peptide
GVEINVSCSGSPQCLKPCKDAGMRFGKCMNRKCHCTPK

SEQ ID NO: 328 - protein, 38 aa, Artificial Sequence
  Definition of Artificial Sequence: Synthetic peptide
GVEINVACSGSPQCLKPCKDAGMRFGKCMNRKCHCTPK

SEQ ID NO: 329 - protein, 37 aa, Artificial Sequence
  Definition of Artificial Sequence: Synthetic peptide
QFTQESCTASNQCWSICKRLHNTNRGKCMNKKCRCYS

SEQ ID NO: 330 - protein, 34 aa, Artificial Sequence
  Definition of Artificial Sequence: Synthetic peptide
VSCAGSKDCYAPCRKQTGCPNAKCINKSCKCYGC

SEQ ID NO: 331 - protein, 34 aa, Artificial Sequence
  Definition of Artificial Sequence: Synthetic peptide
VSCTGAKDCYAPCRKQTGCPNAKCINKSCKCYGC

SEQ ID NO: 332 - protein, 34 aa, Artificial Sequence
  Definition of Artificial Sequence: Synthetic peptide
VSCTGSADCYAPCRKQTGCPNAKCINKSCKCYGC

SEQ ID NO: 333 - protein, 34 aa, Artificial Sequence
  Definition of Artificial Sequence: Synthetic peptide
VSCTGSKDCAAPCRKQTGCPNAKCINKSCKCYGC

SEQ ID NO: 334 - protein, 34 aa, Artificial Sequence
  Definition of Artificial Sequence: Synthetic peptide
VSCTGSKDCYAPCQKQTGCPNAKCINKSCKCYGC

SEQ ID NO: 335 - protein, 34 aa, Artificial Sequence
  Definition of Artificial Sequence: Synthetic peptide
VSCTGSKDCYAPCRQQTGCPNAKCINKSCKCYGC

SEQ ID NO: 336 - protein, 34 aa, Artificial Sequence
  Definition of Artificial Sequence: Synthetic peptide
VSCTGSKDCYAPCQQQTGCPNAKCINKSCKCYGC

SEQ ID NO: 337 - protein, 34 aa, Artificial Sequence
  Definition of Artificial Sequence: Synthetic peptide
VSCTGSKDCYAPCRKQTGCPNAKCINKSCKCYAC

SEQ ID NO: 338 - protein, 34 aa, Artificial Sequence
  Definition of Artificial Sequence: Synthetic peptide
VSCTGSKDCYAPCRKQTGCPYGKCMNRKCKCNRC

SEQ ID NO: 339 - protein, 34 aa, Artificial Sequence
  Definition of Artificial Sequence: Synthetic peptide
VSCTGSKDCYAACRKQTGCANAKCINKSCKCYGC

SEQ ID NO: 340 - protein, 34 aa, Artificial Sequence
  Definition of Artificial Sequence: Synthetic peptide
  MOD_RES (19)..(19): any nonfunctional amino acid
  MOD_RES (34)..(34): any nonfunctional amino acid
VSCTGSKDCYAPCRKQTGXPNAKCINKSCKCYGX

SEQ ID NO: 341 - protein, 34 aa, Artificial Sequence
  Definition of Artificial Sequence: Synthetic peptide
VSCTGSKDCYAPCRKQTGSPNAKCINKSCKCYGS

SEQ ID NO: 342 - protein, 34 aa, Artificial Sequence; identical to SEQ ID NO: 332
  Definition of Artificial Sequence: Synthetic peptide

SEQ ID NO: 343 - protein, 38 aa, Artificial Sequence
  Definition of Artificial Sequence: Synthetic peptide
VVIGQRCTGSKDCYAPCRKQTGCPNAKCINKSCKCYGC

SEQ ID NO: 344 - protein, 37 aa, Artificial Sequence
  Definition of Artificial Sequence: Synthetic peptide
QFTNVSCTTSKECWSVCQRLHNTSRGKCMNKDCRCYS

SEQ ID NO: 345 - protein, 31 aa, Artificial Sequence
  Definition of Artificial Sequence: Synthetic peptide
CTTSKECWSVCQRLHNTSRGKCMNKKCRCYS

SEQ ID NO: 346 - protein, 37 aa, Artificial Sequence
  Definition of Artificial Sequence: Synthetic peptide
QFTNVSCTTSKECWSVCQRLFGVDRGKCMGKKCRCYQ

SEQ ID NO: 347 - protein, 26 aa, Artificial Sequence
  Definition of Artificial Sequence: Synthetic peptide
CKLKGQSCRKTSYDCCSGSCGRSGKC

SEQ ID NO: 348 - protein, 19 aa, Artificial Sequence
  Definition of Artificial Sequence: Synthetic peptide
  MOD_RES (4)..(4): variable amino acid
CNCXAPETALCARRCQQHG

SEQ ID NO: 349 - protein, 19 aa, Artificial Sequence
  Definition of Artificial Sequence: Synthetic peptide
CNCAAPETALCARRCQQHG

SEQ ID NO: 350 - protein, 19 aa, Artificial Sequence
  Definition of Artificial Sequence: Synthetic peptide
  MOD_RES (13)..(13): variable amino acid
CNCKAPETALCAXRCQQHG

SEQ ID NO: 351 - protein, 19 aa, Artificial Sequence
  Definition of Artificial Sequence: Synthetic peptide
CNCKAPETALCAARCQQHG

SEQ ID NO: 352 - protein, 19 aa, Artificial Sequence
  Definition of Artificial Sequence: Synthetic peptide
  MOD_RES (14)..(14): variable amino acid
CNCKAPETALCARXCQQHG

SEQ ID NO: 353 - protein, 19 aa, Artificial Sequence
  Definition of Artificial Sequence: Synthetic peptide
CNCKAPETALCARACQQHG

SEQ ID NO: 354 - protein, 31 aa, Artificial Sequence
  Definition of Artificial Sequence: Synthetic peptide
AFCNLRRCQLSCRSLGLLGKCIGDKCECVKH

SEQ ID NO: 355 - protein, 31 aa, Artificial Sequence
  Definition of Artificial Sequence: Synthetic peptide
AFCNLRMCQLSCRSLGLLGKCMGKKCRCVKH

SEQ ID NO: 356 - protein, 31 aa, Artificial Sequence
  Definition of Artificial Sequence: Synthetic peptide
AFSNLRMCQLSCRSLGLLGKSIGDKCECVKH

SEQ ID NO: 357 - protein, 37 aa, Artificial Sequence
  Definition of Artificial Sequence: Synthetic peptide
  MOD_RES (11)..(11): variable amino acid
QFTDVDCSVSXECWSVCKDLFGVDRGKCMGKKCRCYQ

SEQ ID NO: 358 - protein, 37 aa, Artificial Sequence
  Definition of Artificial Sequence: Synthetic peptide
QFTDVDCSVSAECWSVCKDLFGVDRGKCMGKKCRCYQ

SEQ ID NO: 359 - protein, 37 aa, Artificial Sequence
  Definition of Artificial Sequence: Synthetic peptide
  MOD_RES (18)..(18): variable amino acid
QFTDVDCSVSKECWSVCXDLFGVDRGKCMGKKCRCYQ

SEQ ID NO: 360 - protein, 37 aa, Artificial Sequence
  Definition of Artificial Sequence: Synthetic peptide
QFTDVDCSVSKECWSVCADLFGVDRGKCMGKKCRCYQ

SEQ ID NO: 361 - protein, 37 aa, Artificial Sequence
  Definition of Artificial Sequence: Synthetic peptide
  MOD_RES (25)..(25): variable amino acid
QFTDVDCSVSKECWSVCKDLFGVDXGKCMGKKCRCYQ

SEQ ID NO: 362 - protein, 37 aa, Artificial Sequence
  Definition of Artificial Sequence: Synthetic peptide
QFTDVDCSVSKECWSVCKDLFGVDAGKCMGKKCRCYQ

SEQ ID NO: 363 - protein, 37 aa, Artificial Sequence
  Definition of Artificial Sequence: Synthetic peptide
  MOD_RES (27)..(27): variable amino acid
QFTDVDCSVSKECWSVCKDLFGVDRGXCMGKKCRCYQ

SEQ ID NO: 364 - protein, 37 aa, Artificial Sequence
  Definition of Artificial Sequence: Synthetic peptide
QFTDVDCSVSKECWSVCKDLFGVDRGACMGKKCRCYQ

SEQ ID NO: 365 - protein, 37 aa, Artificial Sequence
  Definition of Artificial Sequence: Synthetic peptide
  MOD_RES (31)..(31): variable amino acid
QFTDVDCSVSKECWSVCKDLFGVDRGKCMGXKCRCYQ

SEQ ID NO: 366 - protein, 37 aa, Artificial Sequence
  Definition of Artificial Sequence: Synthetic peptide
QFTDVDCSVSKECWSVCKDLFGVDRGKCMGAKCRCYQ

SEQ ID NO: 367 - protein, 37 aa, Artificial Sequence
  Definition of Artificial Sequence: Synthetic peptide
  MOD_RES (32)..(32): variable amino acid
QFTDVDCSVSKECWSVCKDLFGVDRGKCMGKXCRCYQ

SEQ ID NO: 368 - protein, 37 aa, Artificial Sequence
  Definition of Artificial Sequence: Synthetic peptide
QFTDVDCSVSKECWSVCKDLFGVDRGKCMGKACRCYQ

SEQ ID NO: 369 - protein, 37 aa, Artificial Sequence
  Definition of Artificial Sequence: Synthetic peptide
  MOD_RES (34)..(34): variable amino acid
QFTDVDCSVSKECWSVCKDLFGVDRGKCMGKKCXCYQ

SEQ ID NO: 370 - protein, 37 aa, Artificial Sequence
  Definition of Artificial Sequence: Synthetic peptide
QFTDVDCSVSKECWSVCKDLFGVDRGKCMGKKCACYQ

SEQ ID NO: 371 - protein, 37 aa, Artificial Sequence; identical to SEQ ID NO: 40
  Definition of Artificial Sequence: Synthetic peptide

SEQ ID NO: 372 - protein, 37 aa, Artificial Sequence
  Definition of Artificial Sequence: Synthetic peptide
  MOD_RES (6)..(6): variable amino acid
QFTDVXCTGSKQCWPVCKQMFGKPNGKCMNGKCRCYS

SEQ ID NO: 373 - protein, 37 aa, Artificial Sequence
  Definition of Artificial Sequence: Synthetic peptide
QFTDVACTGSKQCWPVCKQMFGKPNGKCMNGKCRCYS

SEQ ID NO: 374 - protein, 37 aa, Artificial Sequence
  Definition of Artificial Sequence: Synthetic peptide
  MOD_RES (11)..(11): variable amino acid
QFTDVKCTGSXQCWPVCKQMFGKPNGKCMNGKCRCYS

SEQ ID NO: 375 - protein, 37 aa, Artificial Sequence
  Definition of Artificial Sequence: Synthetic peptide
QFTDVKCTGSAQCWPVCKQMFGKPNGKCMNGKCRCYS

SEQ ID NO: 376 - protein, 37 aa, Artificial Sequence
  Definition of Artificial Sequence: Synthetic peptide
  MOD_RES (18)..(18): variable amino acid
QFTDVKCTGSKQCWPVCXQMFGKPNGKCMNGKCRCYS

SEQ ID NO: 377 - protein, 37 aa, Artificial Sequence
  Definition of Artificial Sequence: Synthetic peptide
QFTDVKCTGSKQCWPVCAQMFGKPNGKCMNGKCRCYS

SEQ ID NO: 378 - protein, 37 aa, Artificial Sequence
  Definition of Artificial Sequence: Synthetic peptide
  MOD_RES (23)..(23): variable amino acid
QFTDVKCTGSKQCWPVCKQMFGXPNGKCMNGKCRCYS

SEQ ID NO: 379 - protein, 37 aa, Artificial Sequence
  Definition of Artificial Sequence: Synthetic peptide
QFTDVKCTGSKQCWPVCKQMFGAPNGKCMNGKCRCYS

SEQ ID NO: 380 - protein, 37 aa, Artificial Sequence
  Definition of Artificial Sequence: Synthetic peptide
  MOD_RES (27)..(27): variable amino acid
QFTDVKCTGSKQCWPVCKQMFGKPNGXCMNGKCRCYS

SEQ ID NO: 381 - protein, 37 aa, Artificial Sequence
  Definition of Artificial Sequence: Synthetic peptide
QFTDVKCTGSKQCWPVCKQMFGKPNGACMNGKCRCYS

SEQ ID NO: 382 - protein, 37 aa, Artificial Sequence
  Definition of Artificial Sequence: Synthetic peptide
  MOD_RES (32)..(32): variable amino acid
QFTDVKCTGSKQCWPVCKQMFGKPNGKCMNGXCRCYS

SEQ ID NO: 383 - protein, 36 aa, Artificial Sequence
  Definition of Artificial Sequence: Synthetic peptide
QFTDVKCTGSKQCWPVCKQMFGKPNGKCMNGARCYS

SEQ ID NO: 384 - protein, 36 aa, Artificial Sequence
  Definition of Artificial Sequence: Synthetic peptide
  MOD_RES (34)..(34): variable amino acid
QFTDVKCTGSKQCWPVCKQMFGKPNGKCMNGKCXYS

SEQ ID NO: 385 - protein, 36 aa, Artificial Sequence
  Definition of Artificial Sequence: Synthetic peptide
QFTDVKCTGSKQCWPVCKQMFGKPNGKCMNGKCAYS

SEQ ID NO: 386 - protein, 41 aa, Artificial Sequence; identical to SEQ ID NO: 41
  Definition of Artificial Sequence: Synthetic peptide

SEQ ID NO: 387 - protein, 40 aa, Artificial Sequence
  Definition of Artificial Sequence: Synthetic peptide
  MOD_RES (14)..(14): variable amino acid
WCSTCLDLACGASXCYDPCFKAFGRAHGKCMNNKCRCYTN

SEQ ID NO: 388 - protein, 40 aa, Artificial Sequence
  Definition of Artificial Sequence: Synthetic peptide
WCSTCLDLACGASACYDPCFKAFGRAHGKCMNNKCRCYTN

SEQ ID NO: 389 - protein, 40 aa, Artificial Sequence
  Definition of Artificial Sequence: Synthetic peptide
  MOD_RES (22)..(22): variable amino acid
WCSTCLDLACGASRECYDPCFXFGRAHGKCMNNKCRCYTN

SEQ ID NO: 390 - protein, 39 aa, Artificial Sequence
  Definition of Artificial Sequence: Synthetic peptide
WCSTCLDLACGASRECYDPCFAGRAHGKCMNNKCRCYTN

SEQ ID NO: 391 - protein, 40 aa, Artificial Sequence
  Definition of Artificial Sequence: Synthetic peptide
  MOD_RES (26)..(26): variable amino acid
WCSTCLDLACGASRECYDPCFKAFGXHGKCMNNKCRCYTN

SEQ ID NO: 392 - protein, 40 aa, Artificial Sequence
  Definition of Artificial Sequence: Synthetic peptide
WCSTCLDLACGASRECYDPCFKAFGAHGKCMNNKCRCYTN

SEQ ID NO: 393 - protein, 40 aa, Artificial Sequence
  Definition of Artificial Sequence: Synthetic peptide
  MOD_RES (30)..(30): variable amino acid
WCSTCLDLACGASRECYDPCFKAFGRAHGXMNNKCRCYTN

SEQ ID NO: 394 - protein, 40 aa, Artificial Sequence
  Definition of Artificial Sequence: Synthetic peptide
WCSTCLDLACGASRECYDPCFKAFGRAHGAMNNKCRCYTN

SEQ ID NO: 395 - protein, 40 aa, Artificial Sequence
  Definition of Artificial Sequence: Synthetic peptide
  MOD_RES (35)..(35): variable amino acid
WCSTCLDLACGASRECYDPCFKAFGRAHGKCMNNXRCYTN

SEQ ID NO: 396 - protein, 40 aa, Artificial Sequence
  Definition of Artificial Sequence: Synthetic peptide
WCSTCLDLACGASRECYDPCFKAFGRAHGKCMNNARCYTN

SEQ ID NO: 397 - protein, 40 aa, Artificial Sequence
  Definition of Artificial Sequence: Synthetic peptide
  MOD_RES (37)..(37): variable amino acid
WCSTCLDLACGASRECYDPCFKAFGRAHGKCMNNKCXYTN

SEQ ID NO: 398 - protein, 40 aa, Artificial Sequence
  Definition of Artificial Sequence: Synthetic peptide
WCSTCLDLACGASRECYDPCFKAFGRAHGKCMNNKCAYTN

SEQ ID NO: 399 - protein, 37 aa, Artificial Sequence
  Definition of Artificial Sequence: Synthetic peptide
  MOD_RES (7)..(7): variable amino acid
FGLIDVXCFASSECWTACKKVTGSGQGKCQNNQCRCY

SEQ ID NO: 400 - protein, 37 aa, Artificial Sequence
  Definition of Artificial Sequence: Synthetic peptide
FGLIDVACFASSECWTACKKVTGSGQGKCQNNQCRCY

SEQ ID NO: 401 - protein, 37 aa, Artificial Sequence
  Definition of Artificial Sequence: Synthetic peptide
  MOD_RES (19)..(19): variable amino acid
FGLIDVKCFASSECWTACXKVTGSGQGKCQNNQCRCY

SEQ ID NO: 402 - protein, 37 aa, Artificial Sequence
  Definition of Artificial Sequence: Synthetic peptide
FGLIDVKCFASSECWTACAKVTGSGQGKCQNNQCRCY

SEQ ID NO: 403 - protein, 37 aa, Artificial Sequence
  Definition of Artificial Sequence: Synthetic peptide
  MOD_RES (20)..(20): variable amino acid
FGLIDVKCFASSECWTACKXVTGSGQGKCQNNQCRCY

SEQ ID NO: 404 - protein, 37 aa, Artificial Sequence
  Definition of Artificial Sequence: Synthetic peptide
FGLIDVKCFASSECWTACKAVTGSGQGKCQNNQCRCY

SEQ ID NO: 405 - protein, 37 aa, Artificial Sequence
  Definition of Artificial Sequence: Synthetic peptide
  MOD_RES (28)..(28): variable amino acid
FGLIDVKCFASSECWTACKKVTGSGQGXCQNNQCRCY

SEQ ID NO: 406 - protein, 37 aa, Artificial Sequence
  Definition of Artificial Sequence: Synthetic peptide
FGLIDVKCFASSECWTACKKVTGSGQGACQNNQCRCY

SEQ ID NO: 407 - protein, 37 aa, Artificial Sequence
  Definition of Artificial Sequence: Synthetic peptide
  MOD_RES (35)..(35): variable amino acid
FGLIDVKCFASSECWTACKKVTGSGQGKCQNNQCXCY

SEQ ID NO: 408 - protein, 37 aa, Artificial Sequence
  Definition of Artificial Sequence: Synthetic peptide
FGLIDVKCFASSECWTACKKVTGSGQGKCQNNQCACY

SEQ ID NO: 409 - protein, 27 aa, Artificial Sequence
  Definition of Artificial Sequence: Synthetic peptide
CKSKGAKCSKLMYDCCTGSCSGTVGRC

SEQ ID NO: 410 - protein, 25 aa, Artificial Sequence
  Definition of Artificial Sequence: Synthetic peptide
  MOD_RES (2)..(2): variable amino acid
CXGKGAKCSRLMYDCCTGSCRSGKC

SEQ ID NO: 411 - protein, 25 aa, Artificial Sequence
  Definition of Artificial Sequence: Synthetic peptide
CAGKGAKCSRLMYDCCTGSCRSGKC

SEQ ID NO: 412 - protein, 25 aa, Artificial Sequence
  Definition of Artificial Sequence: Synthetic peptide
  MOD_RES (4)..(4): variable amino acid
CKGXGAKCSRLMYDCCTGSCRSGKC

SEQ ID NO: 413 - protein, 25 aa, Artificial Sequence
  Definition of Artificial Sequence: Synthetic peptide
CKGAGAKCSRLMYDCCTGSCRSGKC

SEQ ID NO: 414 - protein, 25 aa, Artificial Sequence
  Definition of Artificial Sequence: Synthetic peptide
  MOD_RES (7)..(7): variable amino acid
CKGKGAXCSRLMYDCCTGSCRSGKC

SEQ ID NO: 415 - protein, 25 aa, Artificial Sequence
  Definition of Artificial Sequence: Synthetic peptide
CKGKGAACSRLMYDCCTGSCRSGKC

SEQ ID NO: 416 - protein, 25 aa, Artificial Sequence
  Definition of Artificial Sequence: Synthetic peptide
  MOD_RES (10)..(10): variable amino acid
CKGKGAKCSXLMYDCCTGSCRSGKC

SEQ ID NO: 417 - protein, 25 aa, Artificial Sequence
  Definition of Artificial Sequence: Synthetic peptide
CKGKGAKCSALMYDCCTGSCRSGKC

SEQ ID NO: 418 - protein, 25 aa, Artificial Sequence
  Definition of Artificial Sequence: Synthetic peptide
  MOD_RES (21)..(21): variable amino acid
CKGKGAKCSRLMYDCCTGSCXSGKC

SEQ ID NO: 419 - protein, 25 aa, Artificial Sequence
  Definition of Artificial Sequence: Synthetic peptide
CKGKGAKCSRLMYDCCTGSCASGKC

SEQ ID NO: 420 - protein, 25 aa, Artificial Sequence
  Definition of Artificial Sequence: Synthetic peptide
  MOD_RES (24)..(24): variable amino acid
CKGKGAKCSRLMYDCCTGSCRSGXC

SEQ ID NO: 421 - protein, 25 aa, Artificial Sequence
  Definition of Artificial Sequence: Synthetic peptide
CKGKGAKCSRLMYDCCTGSCRSGAC

SEQ ID NO: 422 - protein, 27 aa, Artificial Sequence
  Definition of Artificial Sequence: Synthetic peptide
  MOD_RES (2)..(2): variable amino acid
CXSPGSSCSPTSYNCCRSCNPYTKRCY

SEQ ID NO: 423 - protein, 27 aa, Artificial Sequence
  Definition of Artificial Sequence: Synthetic peptide
CASPGSSCSPTSYNCCRSCNPYTKRCY

SEQ ID NO: 424 - protein, 27 aa, Artificial Sequence
  Definition of Artificial Sequence: Synthetic peptide
  MOD_RES (17)..(17): variable amino acid
CKSPGSSCSPTSYNCCXSCNPYTKRCY

SEQ ID NO: 425 - protein, 27 aa, Artificial Sequence
  Definition of Artificial Sequence: Synthetic peptide
CKSPGSSCSPTSYNCCASCNPYTKRCY

SEQ ID NO: 426 - protein, 27 aa, Artificial Sequence
  Definition of Artificial Sequence: Synthetic peptide
  MOD_RES (24)..(24): variable amino acid
CKSPGSSCSPTSYNCCRSCNPYTXRCY

SEQ ID NO: 427 - protein, 27 aa, Artificial Sequence
  Definition of Artificial Sequence: Synthetic peptide
CKSPGSSCSPTSYNCCRSCNPYTARCY

SEQ ID NO: 428 - protein, 27 aa, Artificial Sequence
  Definition of Artificial Sequence: Synthetic peptide
  MOD_RES (25)..(25): variable amino acid
CKSPGSSCSPTSYNCCRSCNPYTKXCY

SEQ ID NO: 429 - protein, 27 aa, Artificial Sequence
  Definition of Artificial Sequence: Synthetic peptide
CKSPGSSCSPTSYNCCRSCNPYTKACY

SEQ ID NO: 430 - protein, 34 aa, Artificial Sequence
  Definition of Artificial Sequence: Synthetic peptide
  MOD_RES (3)..(3): variable amino acid
AEXDCIAPGAPCFGTDKPCCNPRAWCSSYANKCL

SEQ ID NO: 431 - protein, 34 aa, Artificial Sequence
  Definition of Artificial Sequence: Synthetic peptide
AEADCIAPGAPCFGTDKPCCNPRAWCSSYANKCL

SEQ ID NO: 432 - protein, 34 aa, Artificial Sequence
  Definition of Artificial Sequence: Synthetic peptide
  MOD_RES (17)..(17): variable amino acid
AEKDCIAPGAPCFGTDXPCCNPRAWCSSYANKCL

SEQ ID NO: 433 - protein, 34 aa, Artificial Sequence
  Definition of Artificial Sequence: Synthetic peptide
AEKDCIAPGAPCFGTDAPCCNPRAWCSSYANKCL

SEQ ID NO: 434 - protein, 34 aa, Artificial Sequence
  Definition of Artificial Sequence: Synthetic peptide
  MOD_RES (23)..(23): variable amino acid
AEKDCIAPGAPCFGTDKPCCNPXAWCSSYANKCL

SEQ ID NO: 435 - protein, 34 aa, Artificial Sequence
  Definition of Artificial Sequence: Synthetic peptide
AEKDCIAPGAPCFGTDKPCCNPAAWCSSYANKCL

SEQ ID NO: 436 - protein, 34 aa, Artificial Sequence
  Definition of Artificial Sequence: Synthetic peptide
  MOD_RES (32)..(32): variable amino acid
AEKDCIAPGAPCFGTDKPCCNPRAWCSSYANXCL

SEQ ID NO: 437 - protein, 34 aa, Artificial Sequence
  Definition of Artificial Sequence: Synthetic peptide
AEKDCIAPGAPCFGTDKPCCNPRAWCSSYANACL

SEQ ID NO: 438 - protein, 35 aa, Artificial Sequence
  Definition of Artificial Sequence: Synthetic peptide
  MOD_RES (3)..(3): variable amino acid
ECXYWLGGCSAGQTCCKHLVCSRRHGWCVWDGTFS

SEQ ID NO: 439 - protein, 35 aa, Artificial Sequence
  Definition of Artificial Sequence: Synthetic peptide
ECAYWLGGCSAGQTCCKHLVCSRRHGWCVWDGTFS

SEQ ID NO: 440 - protein, 35 aa, Artificial Sequence
  Definition of Artificial Sequence: Synthetic peptide
  MOD_RES (17)..(17): variable amino acid
ECRYWLGGCSAGQTCCXHLVCSRRHGWCVWDGTFS

SEQ ID NO: 441 - protein, 35 aa, Artificial Sequence
  Definition of Artificial Sequence: Synthetic peptide
ECRYWLGGCSAGQTCCAHLVCSRRHGWCVWDGTFS

SEQ ID NO: 442 - protein, 35 aa, Artificial Sequence
  Definition of Artificial Sequence: Synthetic peptide
  MOD_RES (23)..(23): variable amino acid
ECRYWLGGCSAGQTCCKHLVCSXRHGWCVWDGTFS

SEQ ID NO: 443 - protein, 35 aa, Artificial Sequence
  Definition of Artificial Sequence: Synthetic peptide
ECRYWLGGCSAGQTCCKHLVCSARHGWCVWDGTFS

SEQ ID NO: 444 - protein, 35 aa, Artificial Sequence
  Definition of Artificial Sequence: Synthetic peptide
  MOD_RES (24)..(24): variable amino acid
ECRYWLGGCSAGQTCCKHLVCSRXHGWCVWDGTFS

SEQ ID NO: 445 - protein, 35 aa, Artificial Sequence
  Definition of Artificial Sequence: Synthetic peptide
ECRYWLGGCSAGQTCCKHLVCSRAHGWCVWDGTFS

SEQ ID NO: 446 - protein, 35 aa, Artificial Sequence
  Definition of Artificial Sequence: Synthetic peptide
PTDIKCSESYQCFPVCKSRFGKTNGRCVNGFCDCF

SEQ ID NO: 447 - protein, 36 aa, Artificial Sequence
  Definition of Artificial Sequence: Synthetic peptide
  MOD_RES (1)..(1): variable amino acid
XPTDIKCSESYQCFPVCKSRFGKTNGRCVNGFCDCF

SEQ ID NO: 448 - protein, 36 aa, Artificial Sequence
  Definition of Artificial Sequence: Synthetic peptide
APTDIKCSESYQCFPVCKSRFGKTNGRCVNGFCDCF

SEQ ID NO: 449 - protein, 36 aa, Artificial Sequence
  Definition of Artificial Sequence: Synthetic peptide
  MOD_RES (6)..(6): variable amino acid
RPTDIXCSESYQCFPVCKSRFGKTNGRCVNGFCDCF

SEQ ID NO: 450 - protein, 36 aa, Artificial Sequence
  Definition of Artificial Sequence: Synthetic peptide
RPTDIACSESYQCFPVCKSRFGKTNGRCVNGFCDCF

SEQ ID NO: 451 - protein, 36 aa, Artificial Sequence
  Definition of Artificial Sequence: Synthetic peptide
  MOD_RES (18)..(18): variable amino acid
RPTDIKCSESYQCFPVCXSRFGKTNGRCVNGFCDCF

SEQ ID NO: 452 - protein, 36 aa, Artificial Sequence
  Definition of Artificial Sequence: Synthetic peptide
RPTDIKCSESYQCFPVCASRFGKTNGRCVNGFCDCF

SEQ ID NO: 453 - protein, 36 aa, Artificial Sequence
  Definition of Artificial Sequence: Synthetic peptide
  MOD_RES (20)..(20): variable amino acid
RPTDIKCSESYQCFPVCKSXFGKTNGRCVNGFCDCF

SEQ ID NO: 454 - protein, 36 aa, Artificial Sequence
  Definition of Artificial Sequence: Synthetic peptide
RPTDIKCSESYQCFPVCKSAFGKTNGRCVNGFCDCF

SEQ ID NO: 455 - protein, 36 aa, Artificial Sequence
  Definition of Artificial Sequence: Synthetic peptide
  MOD_RES (23)..(23): variable amino acid
RPTDIKCSESYQCFPVCKSRFGXTNGRCVNGFCDCF

SEQ ID NO: 456 - protein, 36 aa, Artificial Sequence
  Definition of Artificial Sequence: Synthetic peptide
RPTDIKCSESYQCFPVCKSRFGATNGRCVNGFCDCF

SEQ ID NO: 457 - protein, 36 aa, Artificial Sequence
  Definition of Artificial Sequence: Synthetic peptide
  MOD_RES (27)..(27): variable amino acid
RPTDIKCSESYQCFPVCKSRFGKTNGXCVNGFCDCF

SEQ ID NO: 458 - protein, 36 aa, Artificial Sequence
  Definition of Artificial Sequence: Synthetic peptide
RPTDIKCSESYQCFPVCKSRFGKTNGACVNGFCDCF

SEQ ID NO: 459 - protein, 22 aa, Artificial Sequence
  Definition of Artificial Sequence: Synthetic peptide
QRCCNGRRGCSSRWCRDHSRCC

SEQ ID NO: 460 - protein, 22 aa, Artificial Sequence
  Definition of Artificial Sequence: Synthetic peptide
  MOD_RES (6)..(7): hydroxyproline
  MOD_RES (17)..(17): hydroxyproline
RDCCTXXKKCKDRQCKXQRCCA

SEQ ID NO: 461 - protein, 22 aa, Artificial Sequence
  Definition of Artificial Sequence: Synthetic peptide
  MOD_RES (6)..(7): hydroxyproline
  MOD_RES (17)..(17): hydroxyproline
RDCCTXXRKCKDRRCKXMRCCA

SEQ ID NO: 462 - protein, 22 aa, Artificial Sequence
  Definition of Artificial Sequence: Synthetic peptide
  MOD_RES (8)..(8): hydroxyproline
  MOD_RES (18)..(18): hydroxyproline
ZRLCCGFXKSCRSRQCKXHRCC

SEQ ID NO: 463 - protein, 22 aa, Artificial Sequence
  Definition of Artificial Sequence: Synthetic peptide
ZRCCNGRRGCSSRWCRDHSRCC

SEQ ID NO: 464 - protein, 31 aa, Artificial Sequence
  Definition of Artificial Sequence: Synthetic peptide
ACRKKWEYCIVPIIGFIYCCPGLICGPFVCV

SEQ ID NO: 465 - protein, 31 aa, Artificial Sequence
  Definition of Artificial Sequence: Synthetic peptide
ACSKKWEYCIVPIIGFIYCCPGLICGPFVCV

SEQ ID NO: 466 - protein, 29 aa, Artificial Sequence
  Definition of Artificial Sequence: Synthetic peptide
  MOD_RES (6)..(6): hydroxyproline
  MOD_RES (14)..(14): hydroxyproline
EACYAXGTFCGIKXGLCCSEFCLPGVCFG

SEQ ID NO: 467 - protein, 31 aa, Artificial Sequence
  Definition of Artificial Sequence: Synthetic peptide
  MOD_RES (14)..(14): hydroxyproline
DGCSSGGTFCGIHXGLCCSEFCFLWCITFID

SEQ ID NO: 468 - protein, 27 aa, Artificial Sequence
  Definition of Artificial Sequence: Synthetic peptide
WCKQSGEMCNLLDQNCCDGYCIVLVCT

SEQ ID NO: 469 - protein, 29 aa, Artificial Sequence
  Definition of Artificial Sequence: Synthetic peptide
VKPCRKEGQLCDPIFQNCCRGWNCVLFCV

SEQ ID NO: 470 - protein, 36 aa, Artificial Sequence
  Definition of Artificial Sequence: Synthetic peptide
  MOD_RES (14)..(14): variable amino acid
MCMPCFTTDHQMAXKCDDCCGGKGRGKCYGPQCLCR

SEQ ID NO: 471 - protein, 36 aa, Artificial Sequence
  Definition of Artificial Sequence: Synthetic peptide
MCMPCFTTDHQMAAKCDDCCGGKGRGKCYGPQCLCR

SEQ ID NO: 472 - protein, 36 aa, Artificial Sequence
  Definition of Artificial Sequence: Synthetic peptide
  MOD_RES (15)..(15): variable amino acid
MCMPCFTTDHQMARXCDDCCGGKGRGKCYGPQCLCR

SEQ ID NO: 473 - protein, 36 aa, Artificial Sequence
  Definition of Artificial Sequence: Synthetic peptide
MCMPCFTTDHQMARACDDCCGGKGRGKCYGPQCLCR

SEQ ID NO: 474 - protein, 36 aa, Artificial Sequence
  Definition of Artificial Sequence: Synthetic peptide
  MOD_RES (23)..(23): variable amino acid
MCMPCFTTDHQMARKCDDCCGGXGRGKCYGPQCLCR

SEQ ID NO: 475 - protein, 36 aa, Artificial Sequence
  Definition of Artificial Sequence: Synthetic peptide
MCMPCFTTDHQMARKCDDCCGGAGRGKCYGPQCLCR

SEQ ID NO: 476 - protein, 36 aa, Artificial Sequence
  Definition of Artificial Sequence: Synthetic peptide
  MOD_RES (25)..(25): variable amino acid
MCMPCFTTDHQMARKCDDCCGGKGXGKCYGPQCLCR

SEQ ID NO: 477 - protein, 36 aa, Artificial Sequence
  Definition of Artificial Sequence: Synthetic peptide
MCMPCFTTDHQMARKCDDCCGGKGAGKCYGPQCLCR

SEQ ID NO: 478 - protein, 36 aa, Artificial Sequence
  Definition of Artificial Sequence: Synthetic peptide
  MOD_RES (27)..(27): variable amino acid
MCMPCFTTDHQMARKCDDCCGGKGRGXCYGPQCLCR

SEQ ID NO: 479 - protein, 36 aa, Artificial Sequence
  Definition of Artificial Sequence: Synthetic peptide
MCMPCFTTDHQMARKCDDCCGGKGRGACYGPQCLCR

SEQ ID NO: 480 - protein, 36 aa, Artificial Sequence
  Definition of Artificial Sequence: Synthetic peptide
  MOD_RES (36)..(36): variable amino acid
MCMPCFTTDHQMARKCDDCCGGKGRGKCYGPQCLCX

SEQ ID NO: 481 - protein, 36 aa, Artificial Sequence
  Definition of Artificial Sequence: Synthetic peptide
MCMPCFTTDHQMARKCDDCCGGKGRGKCYGPQCLCA

SEQ ID NO: 482 - protein, 35 aa, Artificial Sequence
  Definition of Artificial Sequence: Synthetic peptide
MCMPCFTTDHQMARKCDDCCGGKGRGKCYGPQCLC

SEQ ID NO: 483 - protein, 39 aa, Artificial Sequence
  Definition of Artificial Sequence: Synthetic peptide
QTDGCGPCFTTDANMARKCRECCGGNGKCFGPQCLCNRE

SEQ ID NO: 484 - protein, 39 aa, Artificial Sequence
  Definition of Artificial Sequence: Synthetic peptide
  MOD_RES (17)..(17): variable amino acid
QTDGCGPCFTTDANMAXKCRECCGGNGKCFGPQCLCNRE

SEQ ID NO: 485 - protein, 39 aa, Artificial Sequence
  Definition of Artificial Sequence: Synthetic peptide
QTDGCGPCFTTDANMAAKCRECCGGNGKCFGPQCLCNRE

SEQ ID NO: 486 - protein, 39 aa, Artificial Sequence
  Definition of Artificial Sequence: Synthetic peptide
  MOD_RES (18)..(18): variable amino acid
QTDGCGPCFTTDANMARXCRECCGGNGKCFGPQCLCNRE

SEQ ID NO: 487 - protein, 39 aa, Artificial Sequence
  Definition of Artificial Sequence: Synthetic peptide
QTDGCGPCFTTDANMARACRECCGGNGKCFGPQCLCNRE

SEQ ID NO: 488 - protein, 39 aa, Artificial Sequence
  Definition of Artificial Sequence: Synthetic peptide
  MOD_RES (20)..(20): variable amino acid
QTDGCGPCFTTDANMARKCXECCGGNGKCFGPQCLCNRE

SEQ ID NO: 489 - protein, 39 aa, Artificial Sequence
  Definition of Artificial Sequence: Synthetic peptide
QTDGCGPCFTTDANMARKCAECCGGNGKCFGPQCLCNRE

SEQ ID NO: 490 - protein, 39 aa, Artificial Sequence
  Definition of Artificial Sequence: Synthetic peptide
  MOD_RES (28)..(28): variable amino acid
QTDGCGPCFTTDANMARKCRECCGGNGXCFGPQCLCNRE

SEQ ID NO: 491 - protein, 39 aa, Artificial Sequence
  Definition of Artificial Sequence: Synthetic peptide
QTDGCGPCFTTDANMARKCRECCGGNGACFGPQCLCNRE

SEQ ID NO: 492 - protein, 39 aa, Artificial Sequence
  Definition of Artificial Sequence: Synthetic peptide
  MOD_RES (38)..(38): variable amino acid
QTDGCGPCFTTDANMARKCRECCGGNGKCFGPQCLCNXE

SEQ ID NO: 493 - protein, 39 aa, Artificial Sequence
  Definition of Artificial Sequence: Synthetic peptide
QTDGCGPCFTTDANMARKCRECCGGNGKCFGPQCLCNAE

SEQ ID NO: 494 - protein, 35 aa, Artificial Sequence
  Definition of Artificial Sequence: Synthetic peptide
ECRYLFGGCKTTSDCCKHLGCKFRDKYCAWDFTFS

SEQ ID NO: 495 - protein, 35 aa, Artificial Sequence
  Definition of Artificial Sequence: Synthetic peptide
  MOD_RES (3)..(3): variable amino acid
ECXYLFGGCKTTSDCCKHLGCKFRDKYCAWDFTFS

SEQ ID NO: 496 - protein, 35 aa, Artificial Sequence
  Definition of Artificial Sequence: Synthetic peptide
ECAYLFGGCKTTSDCCKHLGCKFRDKYCAWDFTFS

SEQ ID NO: 497 - protein, 35 aa, Artificial Sequence
  Definition of Artificial Sequence: Synthetic peptide
  MOD_RES (10)..(10): variable amino acid
ECRYLFGGCXTTSDCCKHLGCKFRDKYCAWDFTFS

SEQ ID NO: 498 - protein, 35 aa, Artificial Sequence
  Definition of Artificial Sequence: Synthetic peptide
ECRYLFGGCATTSDCCKHLGCKFRDKYCAWDFTFS

SEQ ID NO: 499 - protein, 35 aa, Artificial Sequence
  Definition of Artificial Sequence: Synthetic peptide
  MOD_RES (17)..(17): variable amino acid
ECRYLFGGCKTTSDCCXHLGCKFRDKYCAWDFTFS

SEQ ID NO: 500 - protein, 35 aa, Artificial Sequence
  Definition of Artificial Sequence: Synthetic peptide
ECRYLFGGCKTTSDCCAHLGCKFRDKYCAWDFTFS

SEQ ID NO: 501 - protein, 35 aa, Artificial Sequence
  Definition of Artificial Sequence: Synthetic peptide
  MOD_RES (22)..(22): variable amino acid
ECRYLFGGCKTTSDCCKHLGCXFRDKYCAWDFTFS

SEQ ID NO: 502 - protein, 35 aa, Artificial Sequence
  Definition of Artificial Sequence: Synthetic peptide
ECRYLFGGCKTTSDCCKHLGCAFRDKYCAWDFTFS

SEQ ID NO: 503 - protein, 35 aa, Artificial Sequence
  Definition of Artificial Sequence: Synthetic peptide
  MOD_RES (24)..(24): variable amino acid
ECRYLFGGCKTTSDCCKHLGCKFXDKYCAWDFTFS

SEQ ID NO: 504 - protein, 35 aa, Artificial Sequence
  Definition of Artificial Sequence: Synthetic peptide
ECRYLFGGCKTTSDCCKHLGCKFADKYCAWDFTFS

SEQ ID NO: 505 - protein, 35 aa, Artificial Sequence
  Definition of Artificial Sequence: Synthetic peptide
  MOD_RES (26)..(26): variable amino acid
ECRYLFGGCKTTSDCCKHLGCKFRDXYCAWDFTFS

SEQ ID NO: 506 - protein, 35 aa, Artificial Sequence
  Definition of Artificial Sequence: Synthetic peptide
ECRYLFGGCKTTSDCCKHLGCKFRDAYCAWDFTFS

SEQ ID NO: 507 - protein, 31 aa, Artificial Sequence
  Definition of Artificial Sequence: Synthetic peptide
  MOD_RES (4)..(4): variable amino acid
YCQXWMWTCDEERKCCEGLVCRLWCKRIINM

SEQ ID NO: 508 - protein, 31 aa, Artificial Sequence
  Definition of Artificial Sequence: Synthetic peptide
YCQAWMWTCDEERKCCEGLVCRLWCKRIINM

SEQ ID NO: 509 - protein, 31 aa, Artificial Sequence
  Definition of Artificial Sequence: Synthetic peptide
  MOD_RES (13)..(13): variable amino acid
YCQKWMWTCDEEXKCCEGLVCRLWCKRIINM

SEQ ID NO: 510 - protein, 31 aa, Artificial Sequence
  Definition of Artificial Sequence: Synthetic peptide
YCQKWMWTCDEEAKCCEGLVCRLWCKRIINM

SEQ ID NO: 511 - protein, 31 aa, Artificial Sequence
  Definition of Artificial Sequence: Synthetic peptide
  MOD_RES (14)..(14): variable amino acid
YCQKWMWTCDEERXCCEGLVCRLWCKRIINM

SEQ ID NO: 512 - protein, 31 aa, Artificial Sequence
  Definition of Artificial Sequence: Synthetic peptide
YCQKWMWTCDEERACCEGLVCRLWCKRIINM

SEQ ID NO: 513 - protein, 31 aa, Artificial Sequence
  Definition of Artificial Sequence: Synthetic peptide
  MOD_RES (22)..(22): variable amino acid
YCQKWMWTCDEERKCCEGLVCXLWCKRIINM

SEQ ID NO: 514 - protein, 31 aa, Artificial Sequence
  Definition of Artificial Sequence: Synthetic peptide
YCQKWMWTCDEERKCCEGLVCALWCKRIINM

SEQ ID NO: 515 - protein, 31 aa, Artificial Sequence
  Definition of Artificial Sequence: Synthetic peptide
  MOD_RES (26)..(26): variable amino acid
YCQKWMWTCDEERKCCEGLVCRLWCXRIINM

SEQ ID NO: 516 - protein, 31 aa, Artificial Sequence
  Definition of Artificial Sequence: Synthetic peptide
YCQKWMWTCDEERKCCEGLVCRLWCARIINM

SEQ ID NO: 517 - protein, 31 aa, Artificial Sequence
  Definition of Artificial Sequence: Synthetic peptide
  MOD_RES (27)..(27): variable amino acid
YCQKWMWTCDEERKCCEGLVCRLWCKXIINM

SEQ ID NO: 518 - protein, 31 aa, Artificial Sequence
  Definition of Artificial Sequence: Synthetic peptide
YCQKWMWTCDEERKCCEGLVCRLWCKAIINM

SEQ ID NO: 519 - protein, 16 aa, Artificial Sequence
  Definition of Artificial Sequence: Synthetic peptide
GCCSLPPCAANNPDYC

SEQ ID NO: 520 - protein, 16 aa, Artificial Sequence
  Definition of Artificial Sequence: Synthetic peptide
GCCSLPPCALNNPDYC

SEQ ID NO: 521 - protein, 16 aa, Artificial Sequence
  Definition of Artificial Sequence: Synthetic peptide
GCCSLPPCAASNPDYC

SEQ ID NO: 522 - protein, 16 aa, Artificial Sequence
  Definition of Artificial Sequence: Synthetic peptide
GCCSLPPCALSNPDYC

SEQ ID NO: 523 - protein, 16 aa, Artificial Sequence
  Definition of Artificial Sequence: Synthetic peptide
GCCSLPPCAASNPDYC

SEQ ID NO: 524 - protein, 16 aa, Artificial Sequence
  Definition of Artificial Sequence: Synthetic peptide
GCCSLPPCALNNPDYC

SEQ ID NO: 525 - protein, 16 aa, Artificial Sequence
  Definition of Artificial Sequence: Synthetic peptide
GCCSNPVCHLEHSNLC

SEQ ID NO: 526 - protein, 14 aa, Artificial Sequence
  Definition of Artificial Sequence: Synthetic peptide
GRCCHPACGKNYSC

SEQ ID NO: 527 - protein, 18 aa, Artificial Sequence
  Definition of Artificial Sequence: Synthetic peptide
  MOD_RES (3)..(3): hydroxyproline
RDXCCYHPTCNMSNPQIC

SEQ ID NO: 528 - protein, 15 aa, Artificial Sequence
  Definition of Artificial Sequence: Synthetic peptide
GCCSYPPCFATNPDC

SEQ ID NO: 529 - protein, 18 aa, Artificial Sequence
  Definition of Artificial Sequence: Synthetic peptide
RDPCCSNPVCTVHNPQIC

SEQ ID NO: 530 - protein, 12 aa, Artificial Sequence
  Definition of Artificial Sequence: Synthetic peptide
GCCSDPRCAWRC

SEQ ID NO: 531 - protein, 12 aa, Artificial Sequence
  Definition of Artificial Sequence: Synthetic peptide
ACCSDRRCRWRC

SEQ ID NO: 532 - protein, 13 aa, Artificial Sequence
  Definition of Artificial Sequence: Synthetic peptide
ECCNPACGRHYSC

SEQ ID NO: 533 - protein, 25 aa, Artificial Sequence
  Definition of Artificial Sequence: Synthetic peptide
  MOD_RES (7)..(7): hydroxyproline
  MOD_RES (13)..(13): hydroxyproline
  MOD_RES (20)..(20): hydroxyproline
GCCGSYXNAACHXCSCKDRXSYCGQ

SEQ ID NO: 534 - protein, 29 aa, Artificial Sequence
  Definition of Artificial Sequence: Synthetic peptide
  MOD_RES (6)..(6): hydroxyproline
  MOD_RES (12)..(12): hydroxyproline
  MOD_RES (20)..(21): hydroxyproline
  MOD_RES (26)..(26): hydroxyproline
GCCPYXNAACHXCGCKVGRXXYCDRXSGG

SEQ ID NO: 535 - protein, 24 aa, Artificial Sequence
  Definition of Artificial Sequence: Synthetic peptide
  MOD_RES (2)..(3): hydroxyproline
  MOD_RES (14)..(14): hydroxyproline
HXXCCLYGKCRRYXGCSSASCCQR

SEQ ID NO: 536 - protein, 16 aa, Artificial Sequence
  Definition of Artificial Sequence: Synthetic peptide
GCCSDPRCNMNNPDYC

SEQ ID NO: 537 - protein, 16 aa, Artificial Sequence
  Definition of Artificial Sequence: Synthetic peptide
GCCSHPACAGNNQHIC

SEQ ID NO: 538 - protein, 19 aa, Artificial Sequence
  Definition of Artificial Sequence: Synthetic peptide
  MOD_RES (4)..(4): gamma carboxy glutamic acid
  MOD_RES (16)..(16): hydroxyproline
IRDXCCSNPACRVNNXHVC

SEQ ID NO: 539 - protein, 17 aa, Artificial Sequence
  Definition of Artificial Sequence: Synthetic peptide
GGCCSHPACAANNQDYC

SEQ ID NO: 540 - protein, 16 aa, Artificial Sequence
  Definition of Artificial Sequence: Synthetic peptide
GCCSYPPCFATNSDYC

SEQ ID NO: 541 - protein, 16 aa, Artificial Sequence
  Definition of Artificial Sequence: Synthetic peptide
GCCSYPPCFATNSGYC

SEQ ID NO: 542 - protein, 74 aa, Heteractis magnifica
MKSQMIAAVLLIAFCLCVVVTARMELQDVEDMENGFQKRRTCKDLIPVSECTDIRCRTSMKYRLNLCRKTCGSC

SEQ ID NO: 543 - protein, 74 aa, Heteractis magnifica; identical to SEQ ID NO: 542

SEQ ID NO: 544 - protein, 36 aa, Actinia equina; identical to SEQ ID NO: 7

SEQ ID NO: 545 - protein, 36 aa, Anemonia sulcata; identical to SEQ ID NO: 8

SEQ ID NO: 546 - protein, 37 aa, Bunodosoma granulifera; identical to SEQ ID NO: 9

SEQ ID NO: 547 - protein, 59 aa, Artificial Sequence
  Definition of Artificial Sequence: Synthetic peptide
MKILSVLLLALIICSIIDWSEGQFTQESCTASNQCWSICKRLHNTNRGKCMNKKCRCYS

SEQ ID NO: 548 - protein, 35 aa, Artificial Sequence
  Definition of Artificial Sequence: Synthetic peptide
YSCIDTIPKSRCTAFQCKHSMKYRLSFCRKTCGTC

SEQ ID NO: 549 - protein, 35 aa, Artificial Sequence
  Definition of Artificial Sequence: Synthetic peptide
KSCIDTIPKSRCTAFQCKHSMKYRLSFCRKTCGTC

SEQ ID NO: 550 - protein, 35 aa, Artificial Sequence
  Definition of Artificial Sequence: Synthetic peptide
HSCIDTIPKSRCTAFQCKHSMKYRLSFCRKTCGTC

SEQ ID NO: 551 - protein, 35 aa, Artificial Sequence
  Definition of Artificial Sequence: Synthetic peptide
QSCIDTIPKSRCTAFQCKHSMKYRLSFCRKTCGTC

SEQ ID NO: 552 - protein, 37 aa, Artificial Sequence
  Definition of Artificial Sequence: Synthetic peptide
PPRSCIDTIPKSRCTAFQCKHSMKYRLSFCRKTCGTC

SEQ ID NO: 553 - protein, 36 aa, Artificial Sequence
  Definition of Artificial Sequence: Synthetic peptide
MRSCIDTIPKSRCTAFQCKHSMKYRLSFCRKTCGTC

SEQ ID NO: 554 - protein, 36 aa, Artificial Sequence
  Definition of Artificial Sequence: Synthetic peptide
GRSCIDTIPKSRCTAFQCKHSMKYRLSFCRKTCGTC

SEQ ID NO: 555 - protein, 35 aa, Artificial Sequence
  Definition of Artificial Sequence: Synthetic peptide
YSCIDTIPKSRCTAFQCKHSMAYRLSFCRKTCGTC

SEQ ID NO: 556 - protein, 35 aa, Artificial Sequence
  Definition of Artificial Sequence: Synthetic peptide
KSCIDTIPKSRCTAFQCKHSMAYRLSFCRKTCGTC

SEQ ID NO: 557 - protein, 35 aa, Artificial Sequence
  Definition of Artificial Sequence: Synthetic peptide
HSCIDTIPKSRCTAFQCKHSMAYRLSFCRKTCGTC

SEQ ID NO: 558 - protein, 35 aa, Artificial Sequence
  Definition of Artificial Sequence: Synthetic peptide
QSCIDTIPKSRCTAFQCKHSMAYRLSFCRKTCGTC

SEQ ID NO: 559 - protein, 37 aa, Artificial Sequence
  Definition of Artificial Sequence: Synthetic peptide
PPRSCIDTIPKSRCTAFQCKHSMAYRLSFCRKTCGTC

SEQ ID NO: 560 - protein, 36 aa, Artificial Sequence
  Definition of Artificial Sequence: Synthetic peptide
MRSCIDTIPKSRCTAFQCKHSMAYRLSFCRKTCGTC

SEQ ID NO: 561 - protein, 36 aa, Artificial Sequence
  Definition of Artificial Sequence: Synthetic peptide
GRSCIDTIPKSRCTAFQCKHSMAYRLSFCRKTCGTC

SEQ ID NO: 562 - protein, 38 aa, Artificial Sequence; identical to SEQ ID NO: 297
  Definition of Artificial Sequence: Synthetic peptide
  n-term acetylation

SEQ ID NO: 563 - protein, 38 aa, Artificial Sequence; identical to SEQ ID NO: 297
  Definition of Artificial Sequence: Synthetic peptide
  c-term amidation

SEQ ID NO: 564 - protein, 38 aa, Artificial Sequence; identical to SEQ ID NO: 297
  Definition of Artificial Sequence: Synthetic peptide
  n-term acetylation
  c-term amidation

SEQ ID NO: 565 - protein, 38 aa, Artificial Sequence; identical to SEQ ID NO: 298
  Definition of Artificial Sequence: Synthetic peptide
  c-term amidation

SEQ ID NO: 566 - protein, 38 aa, Artificial Sequence; identical to SEQ ID NO: 298
  Definition of Artificial Sequence: Synthetic peptide
  n-term acetylation

SEQ ID NO: 567 - protein, 38 aa, Artificial Sequence; identical to SEQ ID NO: 298
  Definition of Artificial Sequence: Synthetic peptide
  n-term acetylation
  c-term amidation

SEQ ID NO: 568 - protein, 38 aa, Artificial Sequence; identical to SEQ ID NO: 294
  Definition of Artificial Sequence: Synthetic peptide
  c-term amidation

SEQ ID NO: 569 - protein, 38 aa, Artificial Sequence; identical to SEQ ID NO: 294
  Definition of Artificial Sequence: Synthetic peptide
  n-term acetylation

SEQ ID NO: 570 - protein, 38 aa, Artificial Sequence; identical to SEQ ID NO: 294
  Definition of Artificial Sequence: Synthetic peptide
  n-term acetylation
  c-term amidation

SEQ ID NO: 571 - protein, 38 aa, Artificial Sequence; identical to SEQ ID NO: 295
  Definition of Artificial Sequence: Synthetic peptide
  n-term acetylation

SEQ ID NO: 572 - protein, 38 aa, Artificial Sequence; identical to SEQ ID NO: 295
  Definition of Artificial Sequence: Synthetic peptide
  c-term amidation

SEQ ID NO: 573 - protein, 38 aa, Artificial Sequence; identical to SEQ ID NO: 295
  Definition of Artificial Sequence: Synthetic peptide
  n-term acetylation
  c-term amidation

SEQ ID NO: 574 - protein, 38 aa, Artificial Sequence; identical to SEQ ID NO: 25
  Definition of Artificial Sequence: Synthetic peptide
  c-term amidation

SEQ ID NO: 575 - protein, 38 aa, Artificial Sequence; identical to SEQ ID NO: 25
  Definition of Artificial Sequence: Synthetic peptide
  n-term acetylation

SEQ ID NO: 576 - protein, 38 aa, Artificial Sequence; identical to SEQ ID NO: 25
  Definition of Artificial Sequence: Synthetic peptide
  n-term acetylation
  c-term amidation

SEQ ID NO: 577 - protein, 38 aa, Artificial Sequence; identical to SEQ ID NO: 296
  Definition of Artificial Sequence: Synthetic peptide
  c-term amidation

SEQ ID NO: 578 - protein, 38 aa, Artificial Sequence; identical to SEQ ID NO: 296
  Definition of Artificial Sequence: Synthetic peptide
  n-term acetylation

SEQ ID NO: 579 - protein, 38 aa, Artificial Sequence; identical to SEQ ID NO: 296
  Definition of Artificial Sequence: Synthetic peptide
  n-term acetylation
  c-term amidation

SEQ ID NO: 580 - protein, 37 aa, Artificial Sequence
  Definition of Artificial Sequence: Synthetic peptide
VIINVKCKISRQCLEPCKKAGMRFGKCMNGKCHCTPK

SEQ ID NO: 581 - protein, 37 aa, Artificial Sequence; identical to SEQ ID NO: 580
  Definition of Artificial Sequence: Synthetic peptide
  n-term acetylation

SEQ ID NO: 582 - protein, 37 aa, Artificial Sequence; identical to SEQ ID NO: 580
  Definition of Artificial Sequence: Synthetic peptide
  c-term amidation

SEQ ID NO: 583 - protein, 37 aa, Artificial Sequence; identical to SEQ ID NO: 580
  Definition of Artificial Sequence: Synthetic peptide
  n-term acetylation
  c-term amidation

SEQ ID NO: 584 - protein, 38 aa, Artificial Sequence
  Definition of Artificial Sequence: Synthetic peptide
GVIINVKCKISRQCLEPCKKAGMRFGKCMNGKCACTPK

SEQ ID NO: 585 - protein, 38 aa, Artificial Sequence; identical to SEQ ID NO: 584
  Definition of Artificial Sequence: Synthetic peptide
  n-term acetylation

SEQ ID NO: 586 - protein, 38 aa, Artificial Sequence; identical to SEQ ID NO: 584
  Definition of Artificial Sequence: Synthetic peptide
  c-term amidation

SEQ ID NO: 587 - protein, 38 aa, Artificial Sequence; identical to SEQ ID NO: 584
  Definition of Artificial Sequence: Synthetic peptide
  n-term acetylation
  c-term amidation

SEQ ID NO: 588 - protein, 37 aa, Artificial Sequence
  Definition of Artificial Sequence: Synthetic peptide
VIINVKCKISRQCLKPCKDAGMRFGKCMNGKCHCTPK

SEQ ID NO: 589 - protein, 37 aa, Artificial Sequence; identical to SEQ ID NO: 588
  Definition of Artificial Sequence: Synthetic peptide
  n-term acetylation

SEQ ID NO: 590 - protein, 37 aa, Artificial Sequence; identical to SEQ ID NO: 588
  Definition of Artificial Sequence: Synthetic peptide
  c-term amidation

SEQ ID NO: 591 - protein, 37 aa, Artificial Sequence; identical to SEQ ID NO: 588
  Definition of Artificial Sequence: Synthetic peptide
  n-term acetylation
  c-term amidation

SEQ ID NO: 592 - protein, 34 aa, Artificial Sequence
  Definition of Artificial Sequence: Synthetic peptide
NVKCKISRQCLKPCKDAGMRFGKCMNGKCHCTPK

SEQ ID NO: 593 - protein, 34 aa, Artificial Sequence; identical to SEQ ID NO: 592
  Definition of Artificial Sequence: Synthetic peptide
  n-term acetylation

SEQ ID NO: 594 - protein, 34 aa, Artificial Sequence; identical to SEQ ID NO: 592
  Definition of Artificial Sequence: Synthetic peptide
  c-term amidation

SEQ ID NO: 595 - protein, 34 aa, Artificial Sequence; identical to SEQ ID NO: 592
  Definition of Artificial Sequence: Synthetic peptide
  n-term acetylation
  c-term amidation

SEQ ID NO: 596 - protein, 32 aa, Artificial Sequence
  Definition of Artificial Sequence: Synthetic peptide
KCKISRQCLKPCKDAGMRFGKCMNGKCHCTPK

SEQ ID NO: 597 - protein, 32 aa, Artificial Sequence; identical to SEQ ID NO: 596
  Definition of Artificial Sequence: Synthetic peptide
  n-term acetylation

SEQ ID NO: 598 - protein, 32 aa, Artificial Sequence; identical to SEQ ID NO: 596
  Definition of Artificial Sequence: Synthetic peptide
  c-term amidation

SEQ ID NO: 599 - protein, 32 aa, Artificial Sequence; identical to SEQ ID NO: 596
  Definition of Artificial Sequence: Synthetic peptide
  n-term acetylation
  c-term amidation

SEQ ID NO: 600 - protein, 31 aa, Artificial Sequence
  Definition of Artificial Sequence: Synthetic peptide
CKISRQCLKPCKDAGMRFGKCMNGKCHCTPK

SEQ ID NO: 601 - protein, 31 aa, Artificial Sequence; identical to SEQ ID NO: 600
  Definition of Artificial Sequence: Synthetic peptide
  n-term acetylation

SEQ ID NO: 602 - protein, 31 aa, Artificial Sequence; identical to SEQ ID NO: 600
  Definition of Artificial Sequence: Synthetic peptide
  c-term amidation

SEQ ID NO: 603 - protein, 31 aa, Artificial Sequence; identical to SEQ ID NO: 600
  Definition of Artificial Sequence: Synthetic peptide
  n-term acetylation
  c-term amidation

SEQ ID NO: 604 - protein, 38 aa, Artificial Sequence
  Definition of Artificial Sequence: Synthetic peptide
GVIINVKCKISRQCLKPCKDAGMRNGKCMNGKCHCTPK

SEQ ID NO: 605 - protein, 38 aa, Artificial Sequence; identical to SEQ ID NO: 604
  Definition of Artificial Sequence: Synthetic peptide
  c-term amidation

SEQ ID NO: 606 - protein, 38 aa, Artificial Sequence; identical to SEQ ID NO: 604
  Definition of Artificial Sequence: Synthetic peptide
  n-term acetylation

SEQ ID NO: 607 - protein, 38 aa, Artificial Sequence; identical to SEQ ID NO: 604
  Definition of Artificial Sequence: Synthetic peptide
  n-term acetylation
  c-term amidation

SEQ ID NO: 608 - protein, 38 aa, Artificial Sequence
  Definition of Artificial Sequence: Synthetic peptide
GVIINVKCKISRQCLKPCKDAGMRFGKCMNRKCHCTPK

SEQ ID NO: 609 - protein, 38 aa, Artificial Sequence; identical to SEQ ID NO: 608
  Definition of Artificial Sequence: Synthetic peptide
  c-term amidation

SEQ ID NO: 610 - protein, 38 aa, Artificial Sequence; identical to SEQ ID NO: 608
  Definition of Artificial Sequence: Synthetic peptide
  n-term acetylation

SEQ ID NO: 611 - protein, 38 aa, Artificial Sequence; identical to SEQ ID NO: 608
  Definition of Artificial Sequence: Synthetic peptide
  n-term acetylation
  c-term amidation

SEQ ID NO: 612 - protein, 38 aa, Artificial Sequence
  Definition of Artificial Sequence: Synthetic peptide
GVIINVKCKISKQCLKPCRDAGMRFGKCMNGKCHCTPK

SEQ ID NO: 613 - protein, 38 aa, Artificial Sequence; identical to SEQ ID NO: 612
  Definition of Artificial Sequence: Synthetic peptide
  n-term acetylation

SEQ ID NO: 614 - protein, 38 aa, Artificial Sequence; identical to SEQ ID NO: 612
  Definition of Artificial Sequence: Synthetic peptide
  c-term amidation

SEQ ID NO: 615 - protein, 38 aa, Artificial Sequence; identical to SEQ ID NO: 612
  Definition of Artificial Sequence: Synthetic peptide
  n-term acetylation
  c-term amidation

SEQ ID NO: 616 - protein, 37 aa, Artificial Sequence
  Definition of Artificial Sequence: Synthetic peptide
TIINVKCKISRQCLKPCKDAGMRFGKCMNGKCHCTPK

SEQ ID NO: 617 - protein, 37 aa, Artificial Sequence; identical to SEQ ID NO: 616
  Definition of Artificial Sequence: Synthetic peptide
  n-term acetylation

SEQ ID NO: 618 - protein, 37 aa, Artificial Sequence; identical to SEQ ID NO: 616
  Definition of Artificial Sequence: Synthetic peptide
  c-term amidation

SEQ ID NO: 619 - protein, 37 aa, Artificial Sequence; identical to SEQ ID NO: 616
  Definition of Artificial Sequence: Synthetic peptide
  n-term acetylation
  c-term amidation

SEQ ID NO: 620 - protein, 38 aa, Artificial Sequence
  Definition of Artificial Sequence: Synthetic peptide
GVKINVKCKISRQCLEPCKKAGMRFGKCMNGKCHCTPK

SEQ ID NO: 621 - protein, 38 aa, Artificial Sequence; identical to SEQ ID NO: 620
  Definition of Artificial Sequence: Synthetic peptide
  n-term acetylation

SEQ ID NO: 622 - protein, 38 aa, Artificial Sequence; identical to SEQ ID NO: 620
  Definition of Artificial Sequence: Synthetic peptide
  c-term amidation

SEQ ID NO: 623 - protein, 38 aa, Artificial Sequence; identical to SEQ ID NO: 620
  Definition of Artificial Sequence: Synthetic peptide
  n-term acetylation
  c-term amidation

SEQ ID NO: 624 - protein, 38 aa, Artificial Sequence
  Definition of Artificial Sequence: Synthetic peptide
GVKINVKCKISRQCLEPCKKAGMRFGKCMNGKCACTPK

SEQ ID NO: 625 - protein, 38 aa, Artificial Sequence
  Definition of Artificial Sequence: Synthetic peptide
GVKINVKCKISRQCLKPCKDAGMRFGKCMNGKCHCTPK

SEQ ID NO: 626 - protein, 38 aa, Artificial Sequence
  Definition of Artificial Sequence: Synthetic peptide
GVKINVKCKISRQCLKPCKDAGMRFGKCMNGKCACTPK

SEQ ID NO: 627 - protein, 38 aa, Artificial Sequence; identical to SEQ ID NO: 624
  Definition of Artificial Sequence: Synthetic peptide
  n-term acetylation

SEQ ID NO: 628 - protein, 38 aa, Artificial Sequence; identical to SEQ ID NO: 624
  Definition of Artificial Sequence: Synthetic peptide
  c-term amidation

SEQ ID NO: 629 - protein, 38 aa, Artificial Sequence; identical to SEQ ID NO: 624
  Definition of Artificial Sequence: Synthetic peptide
  n-term acetylation
  c-term amidation

SEQ ID NO: 630 - protein, 38 aa, Artificial Sequence; identical to SEQ ID NO: 626
  Definition of Artificial Sequence: Synthetic peptide
  n-term acetylation

SEQ ID NO: 631 - protein, 38 aa, Artificial Sequence; identical to SEQ ID NO: 626
  Definition of Artificial Sequence: Synthetic peptide
  c-term amidation

SEQ ID NO: 632 - protein, 38 aa, Artificial Sequence; identical to SEQ ID NO: 626
  Definition of Artificial Sequence: Synthetic peptide
  n-term acetylation
  c-term amidation

SEQ ID NO: 633 - protein, 38 aa, Artificial Sequence; identical to SEQ ID NO: 625
  Definition of Artificial Sequence: Synthetic peptide
  n-term acetylation

SEQ ID NO: 634 - protein, 38 aa, Artificial Sequence; identical to SEQ ID NO: 625
  Definition of Artificial Sequence: Synthetic peptide
  c-term amidation

SEQ ID NO: 635 - protein, 38 aa, Artificial Sequence; identical to SEQ ID NO: 625
  Definition of Artificial Sequence: Synthetic peptide
  n-term acetylation
  c-term amidation

SEQ ID NO: 636 - protein, 36 aa, Artificial Sequence
  Definition of Artificial Sequence: Synthetic peptide
GVIINVKCKISRQCLKPCKDAGMRFGKCMNGKCHCT

SEQ ID NO: 637 - protein, 6 aa, Artificial Sequence
  Definition of Artificial Sequence: Synthetic peptide
  MOD_RES (1)..(2): variable amino acid
  MOD_RES (4)..(5): variable amino acid
XXNXXG

SEQ ID NO: 638 - protein, 5 aa, Artificial Sequence
  Definition of Artificial Sequence: Synthetic peptide
GGGGS

SEQ ID NO: 639 - protein, 6 aa, Artificial Sequence
  Definition of Artificial Sequence: Synthetic peptide
GGEGGG

SEQ ID NO: 640 - protein, 8 aa, Artificial Sequence
  Definition of Artificial Sequence: Synthetic peptide
GGEEEGGG

SEQ ID NO: 641 - protein, 5 aa, Artificial Sequence
  Definition of Artificial Sequence: Synthetic peptide
GEEEG

SEQ ID NO: 642 - protein, 4 aa, Artificial Sequence
  Definition of Artificial Sequence: Synthetic peptide
GEEE

SEQ ID NO: 643 - protein, 6 aa, Artificial Sequence
  Definition of Artificial Sequence: Synthetic peptide
GGDGGG

SEQ ID NO: 644 - protein, 7 aa, Artificial Sequence
  Definition of Artificial Sequence: Synthetic peptide
GGDDDGG

SEQ ID NO: 645 - protein, 5 aa, Artificial Sequence
  Definition of Artificial Sequence: Synthetic peptide
GDDDG

SEQ ID NO: 646 - protein, 4 aa, Artificial Sequence
  Definition of Artificial Sequence: Synthetic peptide
GDDD

SEQ ID NO: 647 - protein, 21 aa, Artificial Sequence
  Definition of Artificial Sequence: Synthetic peptide
GGGGSDDSDEGSDGEDGGGGS

SEQ ID NO: 648 - protein, 5 aa, Artificial Sequence
  Definition of Artificial Sequence: Synthetic peptide
WEWEW

SEQ ID NO: 649 - protein, 5 aa, Artificial Sequence
  Definition of Artificial Sequence: Synthetic peptide
FEFEF

SEQ ID NO: 650 - protein, 6 aa, Artificial Sequence
  Definition of Artificial Sequence: Synthetic peptide
EEEWWW

SEQ ID NO: 651 - protein, 6 aa, Artificial Sequence
  Definition of Artificial Sequence: Synthetic peptide
EEEFFF

SEQ ID NO: 652 - protein, 7 aa, Artificial Sequence
  Definition of Artificial Sequence: Synthetic peptide
WWEEEWW

SEQ ID NO: 653 - protein, 7 aa, Artificial Sequence
  Definition of Artificial Sequence: Synthetic peptide
FFEEEFF

SEQ ID NO: 654 - protein, 6 aa, Artificial Sequence
  Definition of Artificial Sequence: Synthetic peptide
  MOD_RES (1)..(2): variable amino acid
  MOD_RES (4)..(5): variable amino acid
XXYXXG

SEQ ID NO: 655 - protein, 6 aa, Artificial Sequence
  Definition of Artificial Sequence: Synthetic peptide
  MOD_RES (1)..(2): variable amino acid
  MOD_RES (4)..(5): variable amino acid
XXSXXG

SEQ ID NO: 656 - protein, 6 aa, Artificial Sequence
  Definition of Artificial Sequence: Synthetic peptide
  MOD_RES (1)..(2): variable amino acid
  MOD_RES (4)..(5): variable amino acid
XXTXXG

SEQ ID NO: 657 - DNA, 140 bp, Artificial Sequence
  Definition of Artificial Sequence: Synthetic oligonucleotide
  CDS (7)..(132)
ggatccggaggaggaggaagccgcagctgcatcgacaccatccccaagagccgctgcaccgccttccagtgcaagcacagcatgaagtaccgcctgagcttctgccgcaagacctgcggcacctgctaatgagcggccgc

SEQ ID NO: 658 - protein, 40 aa, Artificial Sequence
  Definition of Artificial Sequence: Synthetic peptide
GGGGSRSCIDTIPKSRCTAFQCKHSMKYRLSFCRKTCGTC

SEQ ID NO: 659 - DNA, 81 bp, Artificial Sequence
  Definition of Artificial Sequence: Synthetic oligonucleotide
catggatccggaggaggaggaagccgcagctgcatcgacaccatccccaagagccgctgcaccgccttccagtgcaagcac

SEQ ID NO: 660 - DNA, 82 bp, Artificial Sequence
  Definition of Artificial Sequence: Synthetic oligonucleotide
catgcggccgctcattagcaggtgccgcaggtcttgcggcagaagctcaggcggtacttcatgctgtgcttgcactggaagg

SEQ ID NO: 661 - DNA, 27 bp, Artificial Sequence
  Definition of Artificial Sequence: Synthetic oligonucleotide
catggatccagctgcatcgacaccatc

SEQ ID NO: 662 - DNA, 19 bp, Artificial Sequence
  Definition of Artificial Sequence: Synthetic oligonucleotide
catgcggccgctcattagc

SEQ ID NO: 663 - DNA, 31 bp, Artificial Sequence
  Definition of Artificial Sequence: Synthetic oligonucleotide
catggatccggaggaggaggaagcagctgca

SEQ ID NO: 664 - DNA, 25 bp, Artificial Sequence
  Definition of Artificial Sequence: Synthetic peptide oligonucleotide
catgcggccgctcattagcaggtgc

SEQ ID NO: 665 - DNA, 76 bp, Artificial Sequence
  Definition of Artificial Sequence: Synthetic oligonucleotide
catggatccgggggtgggggttctgggggtgggggttctggaggaggaggaagcggaggaggaggaagcagctgca

SEQ ID NO: 666 - DNA, 25 bp, Artificial Sequence
  Definition of Artificial Sequence: Synthetic oligonucleotide
catgcggccgctcattagcaggtgc

SEQ ID NO: 667 - DNA, 31 bp, Artificial Sequence
  Definition of Artificial Sequence: Synthetic oligonucleotide
ccaacacacttcgaaagacgttgatcggcac

SEQ ID NO: 668 - DNA, 34 bp, Artificial Sequence
  Definition of Artificial Sequence: Synthetic oligonucleotide
cacccaacaatgcatccttaaaaaaattacgccc

SEQ ID NO: 669 - DNA, 42 bp, Artificial Sequence
  Definition of Artificial Sequence: Synthetic oligonucleotide
tggttccggtggtggtggttcccgttcctgcatcgacaccat

SEQ ID NO: 670 - DNA, 85 bp, Artificial Sequence
  Definition of Artificial Sequence: Synthetic oligonucleotide
cccgaaatcccgttgcaccgctttccagtgcaaacactccatgaaataccgtctgtccttctgccgtaaaacctgcggtacctgc

SEQ ID NO: 671 - DNA, 42 bp, Artificial Sequence
  Definition of Artificial Sequence: Synthetic oligonucleotide
cttagcaggtaccgcaggttttacggcagaaggacagacggt

SEQ ID NO: 672 - DNA, 85 bp, Artificial Sequence
  Definition of Artificial Sequence: Synthetic oligonucleotide
atttcatggagtgtttgcactggaaagcggtgcaacgggatttcgggatggtgtcgatgcaggaacgggaaccaccaccaccgga

SEQ ID NO: 673 - DNA, 127 bp, Artificial Sequence
  Definition of Artificial Sequence: Synthetic oligonucleotide
  CDS (2)..(127)
tggttccggtggtggtggttcccgttcctgcatcgacaccatcccgaaatcccgttgcaccgctttccagtgcaaacactccatgaaataccgtctgtccttctgccgtaaaacctgcggtacctgc

SEQ ID NO: 674 - protein, 42 aa, Artificial Sequence
  Definition of Artificial Sequence: Synthetic peptide
GSGGGGSRSCIDTIPKSRCTAFQCKHSMKYRLSFCRKTCGTC

SEQ ID NO: 675 - DNA, 127 bp, Artificial Sequence
  Definition of Artificial Sequence: Synthetic oligonucleotide
cttagcaggtaccgcaggttttacggcagaaggacagacggtatttcatggagtgtttgcactggaaagcggtgcaacgggatttcgggatggtgtcgatgcaggaacgggaaccaccaccaccgga

SEQ ID NO: 676 - DNA, 83 bp, Artificial Sequence
  Definition of Artificial Sequence: Synthetic oligonucleotide
tggttccggtggtggtggttcctgcatcgacaccatcccgaaatcccgttgcaccgctttccagtgcaaacactccatgaaat

SEQ ID NO: 677 - DNA, 38 bp, Artificial Sequence
  Definition of Artificial Sequence: Synthetic oligonucleotide
accgtctgtccttctgccgtaaaacctgcggtacctgc

SEQ ID NO: 678 - DNA, 82 bp, Artificial Sequence
  Definition of Artificial Sequence: Synthetic oligonucleotide
cttagcaggtaccgcaggttttacggcagaaggacagacggtatttcatggagtgtttgcactggaaagcggtgcaacggga

SEQ ID NO: 679 - DNA, 39 bp, Artificial Sequence
  Definition of Artificial Sequence: Synthetic oligonucleotide
tttcgggatggtgtcgatgcaggaaccaccaccaccgga

SEQ ID NO: 680 - DNA, 121 bp, Artificial Sequence
  Definition of Artificial Sequence: Synthetic oligonucleotide
  CDS (2)..(121)
tggttccggtggtggtggttcctgcatcgacaccatcccgaaatcccgttgcaccgctttccagtgcaaacactccatgaaataccgtctgtccttctgccgtaaaacctgcggtacctgc

SEQ ID NO: 681 - protein, 40 aa, Artificial Sequence
  Definition of Artificial Sequence: Synthetic peptide
GSGGGGSCIDTIPKSRCTAFQCKHSMKYRLSFCRKTCGTC

SEQ ID NO: 682 - DNA, 116 bp, Artificial Sequence
  Definition of Artificial Sequence: Synthetic oligonucleotide
caggtaccgcaggttttacggcagaaggacagacggtatttcatggagtgtttgcactggaaagcggtgcaacgggatttcgggatggtgtcgatgcaggaaccaccaccaccgga

SEQ ID NO: 683 - DNA, 11 bp, Artificial Sequence
  Definition of Artificial Sequence: Synthetic oligonucleotide
tggttgagacg

SEQ ID NO: 684 - DNA, 10 bp, Artificial Sequence
  Definition of Artificial Sequence: Synthetic oligonucleotide
tccaccacca

SEQ ID NO: 685 - DNA, 10 bp, Artificial Sequence
  Definition of Artificial Sequence: Synthetic oligonucleotide
taaggatccg

SEQ ID NO: 686 - DNA, 11 bp, Artificial Sequence
  Definition of Artificial Sequence: Synthetic oligonucleotide
gcagagaattc

SEQ ID NO: 687 - DNA, 11 bp, Artificial Sequence
  Definition of Artificial Sequence: Synthetic oligonucleotide
tatgcgagacg

SEQ ID NO: 688 - DNA, 11 bp, Artificial Sequence
  Definition of Artificial Sequence: Synthetic oligonucleotide
ttattgtatac

SEQ ID NO: 689 - DNA, 11 bp, Artificial Sequence
  Definition of Artificial Sequence: Synthetic oligonucleotide
gcagagtccac

SEQ ID NO: 690 - DNA, 42 bp, Artificial Sequence
  Definition of Artificial Sequence: Synthetic oligonucleotide
tggttccggtggtggtggttcccgtacctgcaaagacctgat

SEQ ID NO: 691 - protein, 35 aa, Artificial Sequence
  Definition of Artificial Sequence: Synthetic peptide
RCHFVVCTTDCRRNSPGTYGECVKKEKGKECVCKS

SEQ ID NO: 692 - DNA, 85 bp, Artificial Sequence
  Definition of Artificial Sequence: Synthetic oligonucleotide
cccggtttccgaatgcaccgacatccgttgccgtacctccatgaaataccgtctgaacctgtgccgtaaaacctgcggttcctgc

SEQ ID NO: 693 - DNA, 42 bp, Artificial Sequence
  Definition of Artificial Sequence: Synthetic oligonucleotide
cttagcaggaaccgcaggttttacggcacaggttcagacggt

SEQ ID NO: 694 - DNA, 85 bp, Artificial Sequence
  Definition of Artificial Sequence: Synthetic oligonucleotide
atttcatggaggtacggcaacggatgtcggtgcattcggaaaccgggatcaggtctttgcaggtacgggaaccaccaccaccgga

SEQ ID NO: 695 - DNA, 127 bp, Artificial Sequence
  Definition of Artificial Sequence: Synthetic oligonucleotide
  CDS (2)..(127)
tggttccggtggtggtggttcccgtacctgcaaagacctgatcccggtttccgaatgcaccgacatccgttgccgtacctccatgaaataccgtctgaacctgtgccgtaaaacctgcggttcctgc

SEQ ID NO: 696 - protein, 42 aa, Artificial Sequence
  Definition of Artificial Sequence: Synthetic peptide
GSGGGGSRTCKDLIPVSECTDIRCRTSMKYRLNLCRKTCGSC

SEQ ID NO: 697 - DNA, 127 bp, Artificial Sequence
  Definition of Artificial Sequence: Synthetic oligonucleotide
cttagcaggaaccgcaggttttacggcacaggttcagacggtatttcatggaggtacggcaacggatgtcggtgcattcggaaaccgggatcaggtctttgcaggtacgggaaccaccaccaccgga

SEQ ID NO: 698 - DNA, 47 bp, Artificial Sequence
  Definition of Artificial Sequence: Synthetic oligonucleotide
tggttccggtggtggtggttccggtgttgaaatcaacgttaaatgct

SEQ ID NO: 699 - DNA, 89 bp, Artificial Sequence
  Definition of Artificial Sequence: Synthetic oligonucleotide
ccggttccccgcagtgcctgaaaccgtgcaaagacgctggtatgcgtttcggtaaatgcatgaaccgtaaatgccactgcaccccgaaa

SEQ ID NO: 700 - DNA, 47 bp, Artificial Sequence
  Definition of Artificial Sequence: Synthetic oligonucleotide
cttatttcggggtgcagtggcatttacggttcatgcatttaccgaaa

SEQ ID NO: 701 - DNA, 89 bp, Artificial Sequence
  Definition of Artificial Sequence: Synthetic oligonucleotide
cgcataccagcgtctttgcacggtttcaggcactgcggggaaccggagcatttaacgttgatttcaacaccggaaccaccaccaccgga

SEQ ID NO: 702 - DNA, 136 bp, Artificial Sequence
  Definition of Artificial Sequence: Synthetic oligonucleotide
  CDS (2)..(136)
tggttccggtggtggtggttccggtgttgaaatcaacgttaaatgctccggttccccgcagtgcctgaaaccgtgcaaagacgctggtatgcgtttcggtaaatgcatgaaccgtaaatgccactgcaccccgaaa

SEQ ID NO: 703 - protein, 45 aa, Artificial Sequence
  Definition of Artificial Sequence: Synthetic peptide
GSGGGGSGVEINVKCSGSPQCLKPCKDAGMRFGKCMNRKCHCTPK

SEQ ID NO: 704 - DNA, 136 bp, Artificial Sequence
  Definition of Artificial Sequence: Synthetic oligonucleotide
cttatttcggggtgcagtggcatttacggttcatgcatttaccgaaacgcataccagcgtctttgcacggtttcaggcactgcggggaaccggagcatttaacgttgatttcaacaccggaaccaccaccaccgga

SEQ ID NO: 705 - DNA, 46 bp, Artificial Sequence
  Definition of Artificial Sequence: Synthetic oligonucleotide
tggttccggtggtggtggttccgcttcctgccgtaccccgaaagac

SEQ ID NO: 706 - DNA, 78 bp, Artificial Sequence
  Definition of Artificial Sequence: Synthetic oligonucleotide
tgcgctgacccgtgccgtaaagaaaccggttgcccgtacggtaaatgcatgaaccgtaaatgcaaatgcaaccgttgc

SEQ ID NO: 707 - DNA, 48 bp, Artificial Sequence
  Definition of Artificial Sequence: Synthetic oligonucleotide
cttagcaacggttgcatttgcatttacggttcatgcatttaccgtacg

SEQ ID NO: 708 - DNA, 76 bp, Artificial Sequence
  Definition of Artificial Sequence: Synthetic oligonucleotide
ggcaaccggtttctttacggcacgggtcagcgcagtctttcggggtacggcaggaagcggaaccaccaccaccgga

SEQ ID NO: 709 - DNA, 124 bp, Artificial Sequence
  Definition of Artificial Sequence: Synthetic oligonucleotide
  CDS (2)..(124)
tggttccggtggtggtggttccgcttcctgccgtaccccgaaagactgcgctgacccgtgccgtaaagaaaccggttgcccgtacggtaaatgcatgaaccgtaaatgcaaatgcaaccgttgc

SEQ ID NO: 710 - protein, 41 aa, Artificial Sequence
  Definition of Artificial Sequence: Synthetic peptide
GSGGGGSASCRTPKDCADPCRKETGCPYGKCMNRKCKCNRC

SEQ ID NO: 711 - DNA, 124 bp, Artificial Sequence
  Definition of Artificial Sequence: Synthetic oligonucleotide
cttagcaacggttgcatttgcatttacggttcatgcatttaccgtacgggcaaccggtttctttacggcacgggtcagcgcagtctttcggggtacggcaggaagcggaaccaccaccaccgga

SEQ ID NO: 712 - DNA, 48 bp, Artificial Sequence
  Definition of Artificial Sequence: Synthetic oligonucleotide
tggttccggtggtggtggttccaccatcatcaacgttaaatgcacctc

SEQ ID NO: 713 - DNA, 91 bp, Artificial Sequence
  Definition of Artificial Sequence: Synthetic oligonucleotide
cccgaaacagtgcctgccgccgtgcaaagctcagttcggtcagtccgctggtgctaaatgcatgaacggtaaatgcaaatgctacccgcac

SEQ ID NO: 714 - DNA, 48 bp, Artificial Sequence
  Definition of Artificial Sequence: Synthetic oligonucleotide
cttagtgcgggtagcatttgcatttaccgttcatgcatttagcaccag

SEQ ID NO: 715 - DNA, 91 bp, Artificial Sequence
  Definition of Artificial Sequence: Synthetic oligonucleotide
cggactgaccgaactgagctttgcacggcggcaggcactgtttcggggaggtgcatttaacgttgatgatggtggaaccaccaccaccgga

SEQ ID NO: 716 - DNA, 139 bp, Artificial Sequence
  Definition of Artificial Sequence: Synthetic oligonucleotide
  CDS (2)..(139)
tggttccggtggtggtggttccaccatcatcaacgttaaatgcacctccccgaaacagtgcctgccgccgtgcaaagctcagttcggtcagtccgctggtgctaaatgcatgaacggtaaatgcaaatgctacccgcac

SEQ ID NO: 717 - protein, 46 aa, Artificial Sequence
  Definition of Artificial Sequence: Synthetic peptide
GSGGGGSTIINVKCTSPKQCLPPCKAQFGQSAGAKCMNGKCKCYPH

SEQ ID NO: 718 - DNA, 139 bp, Artificial Sequence
  Definition of Artificial Sequence: Synthetic oligonucleotide
cttagtgcgggtagcatttgcatttaccgttcatgcatttagcaccagcggactgaccgaactgagctttgcacggcggcaggcactgtttcggggaggtgcatttaacgttgatgatggtggaaccaccaccaccgga

SEQ ID NO: 719 - DNA, 52 bp, Artificial Sequence
  Definition of Artificial Sequence: Synthetic oligonucleotide
tggttccggtggtggtggttccggtgttccgatcaacgtttcctgcaccggt

SEQ ID NO: 720 - DNA, 84 bp, Artificial Sequence
  Definition of Artificial Sequence: Synthetic oligonucleotide
tccccgcagtgcatcaaaccgtgcaaagacgctggtatgcgtttcggtaaatgcatgaaccgtaaatgccactgcaccccgaaa

SEQ ID NO: 721 - DNA, 53 bp, Artificial Sequence
  Definition of Artificial Sequence: Synthetic oligonucleotide
cttatttcggggtgcagtggcatttacggttcatgcatttaccgaaacgcata

SEQ ID NO: 722 - DNA, 83 bp, Artificial Sequence
  Definition of Artificial Sequence: Synthetic oligonucleotide
ccagcgtctttgcacggtttgatgcactgcggggaaccggtgcaggaaacgttgatcggaacaccggaaccaccaccaccgga

SEQ ID NO: 723 - DNA, 136 bp, Artificial Sequence
  Definition of Artificial Sequence: Synthetic oligonucleotide
  CDS (2)..(136)
tggttccggtggtggtggttccggtgttccgatcaacgtttcctgcaccggttccccgcagtgcatcaaaccgtgcaaagacgctggtatgcgtttcggtaaatgcatgaaccgtaaatgccactgcaccccgaaa

SEQ ID NO: 724 - protein, 45 aa, Artificial Sequence
  Definition of Artificial Sequence: Synthetic peptide
GSGGGGSGVPINVSCTGSPQCIKPCKDAGMRFGKCMNRKCHCTPK

SEQ ID NO: 725 - DNA, 136 bp, Artificial Sequence
  Definition of Artificial Sequence: Synthetic oligonucleotide
cttatttcggggtgcagtggcatttacggttcatgcatttaccgaaacgcataccagcgtctttgcacggtttgatgcactgcggggaaccggtgcaggaaacgttgatcggaacaccggaaccaccaccaccgga

SEQ ID NO: 726 - DNA, 83 bp, Artificial Sequence
  Definition of Artificial Sequence: Synthetic oligonucleotide
tggttccggtggtggtggttccggtgttatcatcaacgttaaatgcaaaatctcccgtcagtgcctggaaccgtgcaaaaaag

SEQ ID NO: 727 - DNA, 53 bp, Artificial Sequence
  Definition of Artificial Sequence: Synthetic oligonucleotide
ctggtatgcgtttcggtaaatgcatgaacggtaaatgccactgcaccccgaaa

SEQ ID NO: 728 - DNA, 83 bp, Artificial Sequence
  Definition of Artificial Sequence: Synthetic oligonucleotide
cttatttcggggtgcagtggcatttaccgttcatgcatttaccgaaacgcataccagcttttttgcacggttccaggcactga

SEQ ID NO: 729 - DNA, 53 bp, Artificial Sequence
  Definition of Artificial Sequence: Synthetic oligonucleotide
cgggagattttgcatttaacgttgatgataacaccggaaccaccaccaccgga

SEQ ID NO: 730 - DNA, 136 bp, Artificial Sequence
  Definition of Artificial Sequence: Synthetic oligonucleotide
  CDS (2)..(136)
tggttccggtggtggtggttccggtgttatcatcaacgttaaatgcaaaatctcccgtcagtgcctggaaccgtgcaaaaaagctggtatgcgtttcggtaaatgcatgaacggtaaatgccactgcaccccgaaa

SEQ ID NO: 731 - protein, 45 aa, Artificial Sequence
  Definition of Artificial Sequence: Synthetic peptide
GSGGGGSGVIINVKCKISRQCLEPCKKAGMRFGKCMNGKCHCTPK

SEQ ID NO: 732 - DNA, 136 bp, Artificial Sequence
  Definition of Artificial Sequence: Synthetic oligonucleotide
cttatttcggggtgcagtggcatttaccgttcatgcatttaccgaaacgcataccagcttttttgcacggttccaggcactgacgggagattttgcatttaacgttgatgataacaccggaaccaccaccaccgga

SEQ ID NO: 733 - DNA, 83 bp, Artificial Sequence
  Definition of Artificial Sequence: Synthetic oligonucleotide
tggttccggtggtggtggttccggtgttatcatcaacgttaaatgcaaaatctcccgtcagtgcctgaaaccgtgcaaagacg

SEQ ID NO: 734 - DNA, 53 bp, Artificial Sequence; identical to SEQ ID NO: 727
  Definition of Artificial Sequence: Synthetic oligonucleotide

SEQ ID NO: 735 - DNA, 83 bp, Artificial Sequence
  Definition of Artificial Sequence: Synthetic oligonucleotide
cttatttcggggtgcagtggcatttaccgttcatgcatttaccgaaacgcataccagcgtctttgcacggtttcaggcactga

SEQ ID NO: 736 - DNA, 53 bp, Artificial Sequence; identical to SEQ ID NO: 729
  Definition of Artificial Sequence: Synthetic oligonucleotide

SEQ ID NO: 737 - DNA, 136 bp, Artificial Sequence
  Definition of Artificial Sequence: Synthetic oligonucleotide
  CDS (2)..(136)
tggttccggtggtggtggttccggtgttatcatcaacgttaaatgcaaaatctcccgtcagtgcctgaaaccgtgcaaagacgctggtatgcgtttcggtaaatgcatgaacggtaaatgccactgcaccccgaaa

SEQ ID NO: 738 - protein, 45 aa, Artificial Sequence
  Definition of Artificial Sequence: Synthetic peptide
GSGGGGSGVIINVKCKISRQCLKPCKDAGMRFGKCMNGKCHCTPK

SEQ ID NO: 739 - DNA, 136 bp, Artificial Sequence
  Definition of Artificial Sequence: Synthetic oligonucleotide
cttatttcggggtgcagtggcatttaccgttcatgcatttaccgaaacgcataccagcgtctttgcacggtttcaggcactgacgggagattttgcatttaacgttgatgataacaccggaaccaccaccaccgga

SEQ ID NO: 740 - DNA, 83 bp, Artificial Sequence
  Definition of Artificial Sequence: Synthetic oligonucleotide
tggttccggtggtggtggttccaaagaatgcaccggtccgcagcactgcaccaacttctgccgtaaaaacaaatgcacccacg

SEQ ID NO: 741 - DNA, 41 bp, Artificial Sequence
  Definition of Artificial Sequence: Synthetic oligonucleotide
gtaaatgcatgaaccgtaaatgcaaatgcttcaactgcaaa

SEQ ID NO: 742 - DNA, 83 bp, Artificial Sequence
  Definition of Artificial Sequence: Synthetic oligonucleotide
cttatttgcagttgaagcatttgcatttacggttcatgcatttaccgtgggtgcatttgtttttacggcagaagttggtgcag

SEQ ID NO: 743 - DNA, 41 bp, Artificial Sequence
  Definition of Artificial Sequence: Synthetic oligonucleotide
tgctgcggaccggtgcattctttggaaccaccaccaccgga

SEQ ID NO: 744 - DNA, 124 bp, Artificial Sequence
  Definition of Artificial Sequence: Synthetic oligonucleotide
  CDS (2)..(124)
tggttccggtggtggtggttccaaagaatgcaccggtccgcagcactgcaccaacttctgccgtaaaaacaaatgcacccacggtaaatgcatgaaccgtaaatgcaaatgcttcaactgcaaa

SEQ ID NO: 745 - protein, 41 aa, Artificial Sequence
  Definition of Artificial Sequence: Synthetic peptide
GSGGGGSKECTGPQHCTNFCRKNKCTHGKCMNRKCKCFNCK

SEQ ID NO: 746 - DNA, 124 bp, Artificial Sequence
  Definition of Artificial Sequence: Synthetic oligonucleotide
cttatttgcagttgaagcatttgcatttacggttcatgcatttaccgtgggtgcatttgtttttacggcagaagttggtgcagtgctgcggaccggtgcattctttggaaccaccaccaccgga

SEQ ID NO: 747 - DNA, 83 bp, Artificial Sequence
  Definition of Artificial Sequence: Synthetic oligonucleotide
tggttccggtggtggtggttccaccatcatcaacgttaaatgcacctccccgaaacagtgctccaaaccgtgcaaagaactgt

SEQ ID NO: 748 - DNA, 56 bp, Artificial Sequence
  Definition of Artificial Sequence: Synthetic oligonucleotide
acggttcctccgctggtgctaaatgcatgaacggtaaatgcaaatgctacaacaac

SEQ ID NO: 749 - DNA, 83 bp, Artificial Sequence
  Definition of Artificial Sequence: Synthetic oligonucleotide
cttagttgttgtagcatttgcatttaccgttcatgcatttagcaccagcggaggaaccgtacagttctttgcacggtttggag

SEQ ID NO: 750 - DNA, 56 bp, Artificial Sequence
  Definition of Artificial Sequence: Synthetic oligonucleotide
cactgtttcggggaggtgcatttaacgttgatgatggtggaaccaccaccaccgga

SEQ ID NO: 751 - DNA, 139 bp, Artificial Sequence
  Definition of Artificial Sequence: Synthetic oligonucleotide
  CDS (2)..(139)
tggttccggtggtggtggttccaccatcatcaacgttaaatgcacctccccgaaacagtgctccaaaccgtgcaaagaactgtacggttcctccgctggtgctaaatgcatgaacggtaaatgcaaatgctacaacaac

SEQ ID NO: 752 - protein, 46 aa, Artificial Sequence
  Definition of Artificial Sequence: Synthetic peptide
GSGGGGSTIINVKCTSPKQCSKPCKELYGSSAGAKCMNGKCKCYNN

SEQ ID NO: 753 - DNA, 139 bp, Artificial Sequence
  Definition of Artificial Sequence: Synthetic oligonucleotide
cttagttgttgtagcatttgcatttaccgttcatgcatttagcaccagcggaggaaccgtacagttctttgcacggtttggagcactgtttcggggaggtgcatttaacgttgatgatggtggaaccaccaccaccgga

SEQ ID NO: 754 - DNA, 43 bp, Artificial Sequence
  Definition of Artificial Sequence: Synthetic oligonucleotide
tggttccggtggtggtggttccaccatctcctgcaccaacccg

SEQ ID NO: 755 - DNA, 84 bp, Artificial Sequence
  Definition of Artificial Sequence: Synthetic oligonucleotide
aaacagtgctacccgcactgcaaaaaagaaaccggttacccgaacgctaaatgcatgaaccgtaaatgcaaatgcttcggtcgt

SEQ ID NO: 756 - DNA, 44 bp, Artificial Sequence
  Definition of Artificial Sequence: Synthetic oligonucleotide
cttaacgaccgaagcatttgcatttacggttcatgcatttagcg

SEQ ID NO: 757 - DNA, 83 bp, Artificial Sequence
  Definition of Artificial Sequence: Synthetic oligonucleotide
ttcgggtaaccggtttcttttttgcagtgcgggtagcactgtttcgggttggtgcaggagatggtggaaccaccaccaccgga

SEQ ID NO: 758 - DNA, 127 bp, Artificial Sequence
  Definition of Artificial Sequence: Synthetic oligonucleotide
  CDS (2)..(127)
tggttccggtggtggtggttccaccatctcctgcaccaacccgaaacagtgctacccgcactgcaaaaaagaaaccggttacccgaacgctaaatgcatgaaccgtaaatgcaaatgcttcggtcgt

SEQ ID NO: 759 - protein, 42 aa, Artificial Sequence
  Definition of Artificial Sequence: Synthetic peptide
GSGGGGSTISCTNPKQCYPHCKKETGYPNAKCMNRKCKCFGR

SEQ ID NO: 760 - DNA, 127 bp, Artificial Sequence
  Definition of Artificial Sequence: Synthetic oligonucleotide
cttaacgaccgaagcatttgcatttacggttcatgcatttagcgttcgggtaaccggtttcttttttgcagtgcgggtagcactgtttcgggttggtgcaggagatggtggaaccaccaccaccgga

SEQ ID NO: 761 - DNA, 83 bp, Artificial Sequence
  Definition of Artificial Sequence: Synthetic oligonucleotide
tatgcgttcttgtattgatactattccaaaatctcgttgtactgcttttcaatgtaaacattctatgaaatatcgtctttctt

SEQ ID NO: 762 - DNA, 44 bp, Artificial Sequence
  Definition of Artificial Sequence: Synthetic oligonucleotide
tttgtcgtaaaacttgtggtacttgttctggtggtggtggttct

SEQ ID NO: 763 - DNA, 83 bp, Artificial Sequence
  Definition of Artificial Sequence: Synthetic oligonucleotide
caccagaaccaccaccaccagaacaagtaccacaagttttacgacaaaaagaaagacgatatttcatagaatgtttacattga

SEQ ID NO: 764 - DNA, 44 bp, Artificial Sequence
  Definition of Artificial Sequence: Synthetic oligonucleotide
aaagcagtacaacgagattttggaatagtatcaatacaagaacg

SEQ ID NO: 765 - DNA, 127 bp, Artificial Sequence
  Definition of Artificial Sequence: Synthetic oligonucleotide
  CDS (2)..(127)
tatgcgttcttgtattgatactattccaaaatctcgttgtactgcttttcaatgtaaacattctatgaaatatcgtctttctttttgtcgtaaaacttgtggtacttgttctggtggtggtggttct

SEQ ID NO: 766 - protein, 42 aa, Artificial Sequence
  Definition of Artificial Sequence: Synthetic peptide
MRSCIDTIPKSRCTAFQCKHSMKYRLSFCRKTCGTCSGGGGS

SEQ ID NO: 767 - DNA, 127 bp, Artificial Sequence
  Definition of Artificial Sequence: Synthetic oligonucleotide
caccagaaccaccaccaccagaacaagtaccacaagttttacgacaaaaagaaagacgatatttcatagaatgtttacattgaaaagcagtacaacgagattttggaatagtatcaatacaagaacg

SEQ ID NO: 768 - DNA, 80 bp, Artificial Sequence
  Definition of Artificial Sequence: Synthetic oligonucleotide
tatgtcttgtattgatactattccaaaatctcgttgtactgcttttcaatgtaaacattctatgaaatatcgtctttctt

SEQ ID NO: 769 - DNA, 44 bp, Artificial Sequence; identical to SEQ ID NO: 762
  Definition of Artificial Sequence: Synthetic oligonucleotide

SEQ ID NO: 770 - DNA, 83 bp, Artificial Sequence; identical to SEQ ID NO: 763
  Definition of Artificial Sequence: Synthetic oligonucleotide

SEQ ID NO: 771 - DNA, 41 bp, Artificial Sequence
  Definition of Artificial Sequence: Synthetic oligonucleotide
aaagcagtacaacgagattttggaatagtatcaatacaaga

SEQ ID NO: 772 - DNA, 124 bp, Artificial Sequence
  Definition of Artificial Sequence: Synthetic oligonucleotide
  CDS (2)..(124)
tatgtcttgtattgatactattccaaaatctcgttgtactgcttttcaatgtaaacattctatgaaatatcgtctttctttttgtcgtaaaacttgtggtacttgttctggtggtggtggttct

SEQ ID NO: 773 - protein, 41 aa, Artificial Sequence
  Definition of Artificial Sequence: Synthetic peptide
MSCIDTIPKSRCTAFQCKHSMKYRLSFCRKTCGTCSGGGGS

SEQ ID NO: 774 - DNA, 124 bp, Artificial Sequence
  Definition of Artificial Sequence: Synthetic oligonucleotide
caccagaaccaccaccaccagaacaagtaccacaagttttacgacaaaaagaaagacgatatttcatagaatgtttacattgaaaagcagtacaacgagattttggaatagtatcaatacaaga

SEQ ID NO: 775 - DNA, 37 bp, Artificial Sequence
  Definition of Artificial Sequence: Synthetic oligonucleotide
tggttccggtggtggtggttcccagttcaccaacgtt

SEQ ID NO: 776 - DNA, 96 bp, Artificial Sequence
  Definition of Artificial Sequence: Synthetic oligonucleotide
tcctgcaccacctccaaagaatgctggtccgtttgccagcgtctgcacaacacctcccgtggtaaatgcatgaacaaaaaatgccgttgctactcc

SEQ ID NO: 777 - DNA, 38 bp, Artificial Sequence
  Definition of Artificial Sequence: Synthetic oligonucleotide
cttaggagtagcaacggcattttttgttcatgcattta

SEQ ID NO: 778 - DNA, 95 bp, Artificial Sequence
  Definition of Artificial Sequence: Synthetic oligonucleotide
ccacgggaggtgttgtgcagacgctggcaaacggaccagcattctttggaggtggtgcaggaaacgttggtgaactgggaaccaccaccaccgga

SEQ ID NO: 779 - DNA, 133 bp, Artificial Sequence
  Definition of Artificial Sequence: Synthetic oligonucleotide
  CDS (2)..(133)
tggttccggtggtggtggttcccagttcaccaacgtttcctgcaccacctccaaagaatgctggtccgtttgccagcgtctgcacaacacctcccgtggtaaatgcatgaacaaaaaatgccgttgctactcc

SEQ ID NO: 780 - protein, 44 aa, Artificial Sequence
  Definition of Artificial Sequence: Synthetic peptide
GSGGGGSQFTNVSCTTSKECWSVCQRLHNTSRGKCMNKKCRCYS

SEQ ID NO: 781 - DNA, 133 bp, Artificial Sequence
  Definition of Artificial Sequence: Synthetic oligonucleotide
cttaggagtagcaacggcattttttgttcatgcatttaccacgggaggtgttgtgcagacgctggcaaacggaccagcattctttggaggtggtgcaggaaacgttggtgaactgggaaccaccaccaccgga

SEQ ID NO: 782 - DNA, 37 bp, Artificial Sequence
  Definition of Artificial Sequence: Synthetic oligonucleotide
tggttccggtggtggtggttccgtttcctgcaccggt

SEQ ID NO: 783 - DNA, 87 bp, Artificial Sequence
  Definition of Artificial Sequence: Synthetic oligonucleotide
tccaaagactgctacgctccgtgccgtaaacagaccggttgcccgaacgctaaatgcatcaacaaatcctgcaaatgctacggttgc

SEQ ID NO: 784 - DNA, 38 bp, Artificial Sequence
  Definition of Artificial Sequence: Synthetic oligonucleotide
cttagcaaccgtagcatttgcaggatttgttgatgcat

SEQ ID NO: 785 - DNA, 86 bp, Artificial Sequence
  Definition of Artificial Sequence: Synthetic oligonucleotide
ttagcgttcgggcaaccggtctgtttacggcacggagcgtagcagtctttggaaccggtgcaggaaacggaaccaccaccaccgga

SEQ ID NO: 786 - DNA, 124 bp, Artificial Sequence
  Definition of Artificial Sequence: Synthetic oligonucleotide
  CDS (2)..(124)
tggttccggtggtggtggttccgtttcctgcaccggttccaaagactgctacgctccgtgccgtaaacagaccggttgcccgaacgctaaatgcatcaacaaatcctgcaaatgctacggttgc

SEQ ID NO: 787 - protein, 41 aa, Artificial Sequence
  Definition of Artificial Sequence: Synthetic peptide
GSGGGGSVSCTGSKDCYAPCRKQTGCPNAKCINKSCKCYGC

SEQ ID NO: 788 - DNA, 124 bp, Artificial Sequence
  Definition of Artificial Sequence: Synthetic oligonucleotide
cttagcaaccgtagcatttgcaggatttgttgatgcatttagcgttcgggcaaccggtctgtttacggcacggagcgtagcagtctttggaaccggtgcaggaaacggaaccaccaccaccgga

SEQ ID NO: 789 - DNA, 42 bp, Artificial Sequence
  Definition of Artificial Sequence: Synthetic oligonucleotide
tggttccggtggtggtggttcccagttcaccaacgtttcctg

SEQ ID NO: 790 - DNA, 91 bp, Artificial Sequence
  Definition of Artificial Sequence: Synthetic oligonucleotide
caccacctccaaagaatgctggtccgtttgccagcgtctgcacaacacctcccgtggtaaatgcatgaacaaagaatgccgttgctactcc

SEQ ID NO: 791 - DNA, 43 bp, Artificial Sequence
  Definition of Artificial Sequence: Synthetic oligonucleotide
cttaggagtagcaacggcattctttgttcatgcatttaccacg

SEQ ID NO: 792 - DNA, 90 bp, Artificial Sequence
  Definition of Artificial Sequence: Synthetic oligonucleotide
ggaggtgttgtgcagacgctggcaaacggaccagcattctttggaggtggtgcaggaaacgttggtgaactgggaaccaccaccaccgga

SEQ ID NO: 793 - DNA, 133 bp, Artificial Sequence
  Definition of Artificial Sequence: Synthetic oligonucleotide
  CDS (2)..(133)
tggttccggtggtggtggttcccagttcaccaacgtttcctgcaccacctccaaagaatgctggtccgtttgccagcgtctgcacaacacctcccgtggtaaatgcatgaacaaagaatgccgttgctactcc

SEQ ID NO: 794 - protein, 44 aa, Artificial Sequence
  Definition of Artificial Sequence: Synthetic peptide
GSGGGGSQFTNVSCTTSKECWSVCQRLHNTSRGKCMNKECRCYS

SEQ ID NO: 795 - DNA, 133 bp, Artificial Sequence
  Definition of Artificial Sequence: Synthetic oligonucleotide
cttaggagtagcaacggcattctttgttcatgcatttaccacgggaggtgttgtgcagacgctggcaaacggaccagcattctttggaggtggtgcaggaaacgttggtgaactgggaaccaccaccaccgga

SEQ ID NO: 796 - DNA, 79 bp, Artificial Sequence
  Definition of Artificial Sequence: Synthetic oligonucleotide
tggttccggtggtggtggttcctgcaactgcaaagctccggaaaccgctctgtgcgctcgtcgttgccagcagcacggt

SEQ ID NO: 797 - DNA, 79 bp, Artificial Sequence
  Definition of Artificial Sequence: Synthetic oligonucleotide
cttaaccgtgctgctggcaacgacgagcgcacagagcggtttccggagctttgcagttgcaggaaccaccaccaccgga

SEQ ID NO: 798 - DNA, 79 bp, Artificial Sequence; identical to SEQ ID NO: 796
  Definition of Artificial Sequence: Synthetic oligonucleotide
  CDS (2)..(79)

SEQ ID NO: 799 - protein, 26 aa, Artificial Sequence
  Definition of Artificial Sequence: Synthetic peptide
GSGGGGSCNCKAPETALCARRCQQHG

SEQ ID NO: 800 - DNA, 79 bp, Artificial Sequence; identical to SEQ ID NO: 797
  Definition of Artificial Sequence: Synthetic oligonucleotide

SEQ ID NO: 801 - DNA, 39 bp, Artificial Sequence
  Definition of Artificial Sequence: Synthetic oligonucleotide
tggttccggtggtggtggttccgctttctgcaacctgcg

SEQ ID NO: 802 - DNA, 76 bp, Artificial Sequence
  Definition of Artificial Sequence: Synthetic oligonucleotide
tatgtgccagctgtcctgccgttccctgggtctgctgggtaaatgcatcggtgacaaatgcgaatgcgttaaacac

SEQ ID NO: 803 - DNA, 40 bp, Artificial Sequence
  Definition of Artificial Sequence: Synthetic oligonucleotide
cttagtgtttaacgcattcgcatttgtcaccgatgcattt

SEQ ID NO: 804 - DNA, 75 bp, Artificial Sequence
  Definition of Artificial Sequence: Synthetic oligonucleotide
acccagcagacccagggaacggcaggacagctggcacatacgcaggttgcagaaagcggaaccaccaccaccgga

SEQ ID NO: 805 - DNA, 115 bp, Artificial Sequence
  Definition of Artificial Sequence: Synthetic oligonucleotide
  CDS (2)..(115)
tggttccggtggtggtggttccgctttctgcaacctgcgtatgtgccagctgtcctgccgttccctgggtctgctgggtaaatgcatcggtgacaaatgcgaatgcgttaaacac

SEQ ID NO: 806 - protein, 38 aa, Artificial Sequence
  Definition of Artificial Sequence: Synthetic peptide
GSGGGGSAFCNLRMCQLSCRSLGLLGKCIGDKCECVKH

SEQ ID NO: 807 - DNA, 115 bp, Artificial Sequence
  Definition of Artificial Sequence: Synthetic oligonucleotide
cttagtgtttaacgcattcgcatttgtcaccgatgcatttacccagcagacccagggaacggcaggacagctggcacatacgcaggttgcagaaagcggaaccaccaccaccgga

SEQ ID NO: 808 - DNA, 48 bp, Artificial Sequence
  Definition of Artificial Sequence: Synthetic oligonucleotide
tggttccggtggtggtggttcccagttcaccgacgttgactgctccgt

SEQ ID NO: 809 - DNA, 85 bp, Artificial Sequence
  Definition of Artificial Sequence: Synthetic oligonucleotide
ttccaaagaatgctggtccgtttgcaaagacctgttcggtgttgaccgtggtaaatgcatgggtaaaaaatgccgttgctaccag

SEQ ID NO: 810 - DNA, 48 bp, Artificial Sequence
  Definition of Artificial Sequence: Synthetic oligonucleotide
cttactggtagcaacggcattttttacccatgcatttaccacggtcaa

SEQ ID NO: 811 - DNA, 85 bp, Artificial Sequence
  Definition of Artificial Sequence: Synthetic oligonucleotide
caccgaacaggtctttgcaaacggaccagcattctttggaaacggagcagtcaacgtcggtgaactgggaaccaccaccaccgga

SEQ ID NO: 812 - DNA, 133 bp, Artificial Sequence
  Definition of Artificial Sequence: Synthetic oligonucleotide
  CDS (2)..(133)
tggttccggtggtggtggttcccagttcaccgacgttgactgctccgtttccaaagaatgctggtccgtttgcaaagacctgttcggtgttgaccgtggtaaatgcatgggtaaaaaatgccgttgctaccag

SEQ ID NO: 813 - protein, 44 aa, Artificial Sequence
  Definition of Artificial Sequence: Synthetic peptide
GSGGGGSQFTDVDCSVSKECWSVCKDLFGVDRGKCMGKKCRCYQ

SEQ ID NO: 814 - DNA, 133 bp, Artificial Sequence
  Definition of Artificial Sequence: Synthetic oligonucleotide
cttactggtagcaacggcattttttacccatgcatttaccacggtcaacaccgaacaggtctttgcaaacggaccagcattctttggaaacggagcagtcaacgtcggtgaactgggaaccaccaccaccgga

SEQ ID NO: 815 - DNA, 48 bp, Artificial Sequence
  Definition of Artificial Sequence: Synthetic oligonucleotide
tggttccggtggtggtggttccgaatgccgttacctgttcggtggttg

SEQ ID NO: 816 - DNA, 79 bp, Artificial Sequence
  Definition of Artificial Sequence: Synthetic oligonucleotide
caaaaccacctccgactgctgcaaacacctgggttgcaaattccgtgacaaatactgcgcttgggacttcaccttctcc

SEQ ID NO: 817 - DNA, 48 bp, Artificial Sequence
  Definition of Artificial Sequence: Synthetic oligonucleotide
cttaggagaaggtgaagtcccaagcgcagtatttgtcacggaatttgc

SEQ ID NO: 818 - DNA, 79 bp, Artificial Sequence
  Definition of Artificial Sequence: Synthetic oligonucleotide
aacccaggtgtttgcagcagtcggaggtggttttgcaaccaccgaacaggtaacggcattcggaaccaccaccaccgga

SEQ ID NO: 819 - DNA, 127 bp, Artificial Sequence
  Definition of Artificial Sequence: Synthetic oligonucleotide
  CDS (2)..(127)
tggttccggtggtggtggttccgaatgccgttacctgttcggtggttgcaaaaccacctccgactgctgcaaacacctgggttgcaaattccgtgacaaatactgcgcttgggacttcaccttctcc

SEQ ID NO: 820 - protein, 42 aa, Artificial Sequence
  Definition of Artificial Sequence: Synthetic peptide
GSGGGGSECRYLFGGCKTTSDCCKHLGCKFRDKYCAWDFTFS

SEQ ID NO: 821 - DNA, 127 bp, Artificial Sequence
  Definition of Artificial Sequence: Synthetic oligonucleotide
cttaggagaaggtgaagtcccaagcgcagtatttgtcacggaatttgcaacccaggtgtttgcagcagtcggaggtggttttgcaaccaccgaacaggtaacggcattcggaaccaccaccaccgga

SEQ ID NO: 822 - DNA, 38 bp, Artificial Sequence
  Definition of Artificial Sequence: Synthetic oligonucleotide
tggttccggtggtggtggttcctactgccagaaatgga

SEQ ID NO: 823 - DNA, 77 bp, Artificial Sequence
  Definition of Artificial Sequence: Synthetic oligonucleotide
tgtggacctgcgacgaagaacgtaaatgctgcgaaggtctggtttgccgtctgtggtgcaaacgtatcatcaacatg

SEQ ID NO: 824 - DNA, 39 bp, Artificial Sequence
  Definition of Artificial Sequence: Synthetic oligonucleotide
cttacatgttgatgatacgtttgcaccacagacggcaaa

SEQ ID NO: 825 - DNA, 76 bp, Artificial Sequence
  Definition of Artificial Sequence: Synthetic oligonucleotide
ccagaccttcgcagcatttacgttcttcgtcgcaggtccacatccatttctggcagtaggaaccaccaccaccgga

SEQ ID NO: 826 - DNA, 115 bp, Artificial Sequence
  Definition of Artificial Sequence: Synthetic oligonucleotide
  CDS (2)..(115)
tggttccggtggtggtggttcctactgccagaaatggatgtggacctgcgacgaagaacgtaaatgctgcgaaggtctggtttgccgtctgtggtgcaaacgtatcatcaacatg

SEQ ID NO: 827 - protein, 38 aa, Artificial Sequence
  Definition of Artificial Sequence: Synthetic peptide
GSGGGGSYCQKWMWTCDEERKCCEGLVCRLWCKRIINM

SEQ ID NO: 828 - DNA, 115 bp, Artificial Sequence
  Definition of Artificial Sequence: Synthetic oligonucleotide
cttacatgttgatgatacgtttgcaccacagacggcaaaccagaccttcgcagcatttacgttcttcgtcgcaggtccacatccatttctggcagtaggaaccaccaccaccgga

SEQ ID NO: 829 - DNA, 38 bp, Artificial Sequence
  Definition of Artificial Sequence: Synthetic oligonucleotide
tggttccggtggtggtggttcctgcaaatccccgggtt

SEQ ID NO: 830 - DNA, 68 bp, Artificial Sequence
  Definition of Artificial Sequence: Synthetic oligonucleotide
cctcctgctccccgacctcctacaactgctgccgttcctgcaacccgtacaccaaacgttgctacggt

SEQ ID NO: 831 - DNA, 38 bp, Artificial Sequence
  Definition of Artificial Sequence: Synthetic oligonucleotide
cttaaccgtagcaacgtttggtgtacgggttgcaggaa

SEQ ID NO: 832 - DNA, 68 bp, Artificial Sequence
  Definition of Artificial Sequence: Synthetic oligonucleotide
cggcagcagttgtaggaggtcggggagcaggaggaacccggggatttgcaggaaccaccaccaccgga

SEQ ID NO: 833 - DNA, 106 bp, Artificial Sequence
  Definition of Artificial Sequence: Synthetic oligonucleotide
  CDS (2)..(106)
tggttccggtggtggtggttcctgcaaatccccgggttcctcctgctccccgacctcctacaactgctgccgttcctgcaacccgtacaccaaacgttgctacggt

SEQ ID NO: 834 - protein, 35 aa, Artificial Sequence
  Definition of Artificial Sequence: Synthetic peptide
GSGGGGSCKSPGSSCSPTSYNCCRSCNPYTKRCYG

SEQ ID NO: 835 - DNA, 106 bp, Artificial Sequence
  Definition of Artificial Sequence: Synthetic oligonucleotide
cttaaccgtagcaacgtttggtgtacgggttgcaggaacggcagcagttgtaggaggtcggggagcaggaggaacccggggatttgcaggaaccaccaccaccgga

SEQ ID NO: 836 - DNA, 34 bp, Artificial Sequence
  Definition of Artificial Sequence: Synthetic oligonucleotide
tggttccggtggtggtggttcctgcaaaggtaaa

SEQ ID NO: 837 - DNA, 66 bp, Artificial Sequence
  Definition of Artificial Sequence: Synthetic oligonucleotide
ggtgctaaatgctcccgtctgatgtacgactgctgcaccggttcctgccgttccggtaaatgcggt

SEQ ID NO: 838 - DNA, 34 bp, Artificial Sequence
  Definition of Artificial Sequence: Synthetic oligonucleotide
cttaaccgcatttaccggaacggcaggaaccggt

SEQ ID NO: 839 - DNA, 66 bp, Artificial Sequence
  Definition of Artificial Sequence: Synthetic oligonucleotide
gcagcagtcgtacatcagacgggagcatttagcacctttacctttgcaggaaccaccaccaccgga

SEQ ID NO: 840 - DNA, 100 bp, Artificial Sequence
  Definition of Artificial Sequence: Synthetic oligonucleotide
  CDS (2)..(100)
tggttccggtggtggtggttcctgcaaaggtaaaggtgctaaatgctcccgtctgatgtacgactgctgcaccggttcctgccgttccggtaaatgcggt

SEQ ID NO: 841 - protein, 33 aa, Artificial Sequence
  Definition of Artificial Sequence: Synthetic peptide
GSGGGGSCKGKGAKCSRLMYDCCTGSCRSGKCG

SEQ ID NO: 842 - DNA, 100 bp, Artificial Sequence
  Definition of Artificial Sequence: Synthetic oligonucleotide
cttaaccgcatttaccggaacggcaggaaccggtgcagcagtcgtacatcagacgggagcatttagcacctttacctttgcaggaaccaccaccaccgga

SEQ ID NO: 843 - DNA, 40 bp, Artificial Sequence
  Definition of Artificial Sequence: Synthetic oligonucleotide
tggttccggtggtggtggttccgctgaaaaagactgcatc

SEQ ID NO: 844 - DNA, 84 bp, Artificial Sequence
  Definition of Artificial Sequence: Synthetic oligonucleotide
gctccgggtgctccgtgcttcggtaccgacaaaccgtgctgcaacccgcgtgcttggtgctcctcctacgctaacaaatgcctg

SEQ ID NO: 845 - DNA, 40 bp, Artificial Sequence
  Definition of Artificial Sequence: Synthetic oligonucleotide
cttacaggcatttgttagcgtaggaggagcaccaagcacg

SEQ ID NO: 846 - DNA, 84 bp, Artificial Sequence
  Definition of Artificial Sequence: Synthetic oligonucleotide
cgggttgcagcacggtttgtcggtaccgaagcacggagcacccggagcgatgcagtctttttcagcggaaccaccaccaccgga

SEQ ID NO: 847 - DNA, 124 bp, Artificial Sequence
  Definition of Artificial Sequence: Synthetic oligonucleotide
  CDS (2)..(124)
tggttccggtggtggtggttccgctgaaaaagactgcatcgctccgggtgctccgtgcttcggtaccgacaaaccgtgctgcaacccgcgtgcttggtgctcctcctacgctaacaaatgcctg

SEQ ID NO: 848 - protein, 41 aa, Artificial Sequence
  Definition of Artificial Sequence: Synthetic peptide
GSGGGGSAEKDCIAPGAPCFGTDKPCCNPRAWCSSYANKCL

SEQ ID NO: 849 - DNA, 124 bp, Artificial Sequence
  Definition of Artificial Sequence: Synthetic oligonucleotide
cttacaggcatttgttagcgtaggaggagcaccaagcacgcgggttgcagcacggtttgtcggtaccgaagcacggagcacccggagcgatgcagtctttttcagcggaaccaccaccaccgga

SEQ ID NO: 850 - DNA, 41 bp, Artificial Sequence
  Definition of Artificial Sequence: Synthetic oligonucleotide
tggttccggtggtggtggttccgaatgccgttactggctgg

SEQ ID NO: 851 - DNA, 86 bp, Artificial Sequence
  Definition of Artificial Sequence: Synthetic oligonucleotide
gtggttgctccgctggtcagacctgctgcaaacacctggtttgctcccgtcgtcacggttggtgcgtttgggacggtaccttctcc

SEQ ID NO: 852 - DNA, 41 bp, Artificial Sequence
  Definition of Artificial Sequence: Synthetic oligonucleotide
cttaggagaaggtaccgtcccaaacgcaccaaccgtgacga

SEQ ID NO: 853 - DNA, 86 bp, Artificial Sequence
  Definition of Artificial Sequence: Synthetic oligonucleotide
cgggagcaaaccaggtgtttgcagcaggtctgaccagcggagcaaccacccagccagtaacggcattcggaaccaccaccaccgga

SEQ ID NO: 854 - DNA, 127 bp, Artificial Sequence
  Definition of Artificial Sequence: Synthetic oligonucleotide
  CDS (2)..(127)
tggttccggtggtggtggttccgaatgccgttactggctgggtggttgctccgctggtcagacctgctgcaaacacctggtttgctcccgtcgtcacggttggtgcgtttgggacggtaccttctcc

SEQ ID NO: 855 - protein, 42 aa, Artificial Sequence
  Definition of Artificial Sequence: Synthetic peptide
GSGGGGSECRYWLGGCSAGQTCCKHLVCSRRHGWCVWDGTFS

SEQ ID NO: 856 - DNA, 127 bp, Artificial Sequence
  Definition of Artificial Sequence: Synthetic oligonucleotide
cttaggagaaggtaccgtcccaaacgcaccaaccgtgacgacgggagcaaaccaggtgtttgcagcaggtctgaccagcggagcaaccacccagccagtaacggcattcggaaccaccaccaccgga

SEQ ID NO: 857 - DNA, 42 bp, Artificial Sequence
  Definition of Artificial Sequence: Synthetic oligonucleotide
tggttccggtggtggtggttcccgtccgaccgacatcaaatg

SEQ ID NO: 858 - DNA, 88 bp, Artificial Sequence
  Definition of Artificial Sequence: Synthetic oligonucleotide
ctccgaatcctaccagtgcttcccggtttgcaaatcccgtttcggtaaaaccaacggtcgttgcgttaacggtttctgcgactgcttc

SEQ ID NO: 859 - DNA, 42 bp, Artificial Sequence
  Definition of Artificial Sequence: Synthetic oligonucleotide
cttagaagcagtcgcagaaaccgttaacgcaacgaccgttgg

SEQ ID NO: 860 - DNA, 88 bp, Artificial Sequence
  Definition of Artificial Sequence: Synthetic oligonucleotide
ttttaccgaaacgggatttgcaaaccgggaagcactggtaggattcggagcatttgatgtcggtcggacgggaaccaccaccaccgga

SEQ ID NO: 861 - DNA, 130 bp, Artificial Sequence
  Definition of Artificial Sequence: Synthetic oligonucleotide
  CDS (2)..(130)
tggttccggtggtggtggttcccgtccgaccgacatcaaatgctccgaatcctaccagtgcttcccggtttgcaaatcccgtttcggtaaaaccaacggtcgttgcgttaacggtttctgcgactgcttc

SEQ ID NO: 862 - protein, 43 aa, Artificial Sequence
  Definition of Artificial Sequence: Synthetic peptide
GSGGGGSRPTDIKCSESYQCFPVCKSRFGKTNGRCVNGFCDCF

SEQ ID NO: 863 - DNA, 130 bp, Artificial Sequence
  Definition of Artificial Sequence: Synthetic oligonucleotide
cttagaagcagtcgcagaaaccgttaacgcaacgaccgttggttttaccgaaacgggatttgcaaaccgggaagcactggtaggattcggagcatttgatgtcggtcggacgggaaccaccaccaccgga

SEQ ID NO: 864 - DNA, 42 bp, Artificial Sequence
  Definition of Artificial Sequence: Synthetic oligonucleotide
tggttccggtggtggtggttccatgtgcatgccgtgcttcac

SEQ ID NO: 865 - DNA, 88 bp, Artificial Sequence
  Definition of Artificial Sequence: Synthetic oligonucleotide
caccgaccaccagatggctcgtaaatgcgacgactgctgcggtggtaaaggtcgtggtaaatgctacggtccgcagtgcctgtgccgt

SEQ ID NO: 866 - DNA, 42 bp, Artificial Sequence
  Definition of Artificial Sequence: Synthetic oligonucleotide
cttaacggcacaggcactgcggaccgtagcatttaccacgac

SEQ ID NO: 867 - DNA, 88 bp, Artificial Sequence
  Definition of Artificial Sequence: Synthetic oligonucleotide
ctttaccaccgcagcagtcgtcgcatttacgagccatctggtggtcggtggtgaagcacggcatgcacatggaaccaccaccaccgga

SEQ ID NO: 868 - DNA, 130 bp, Artificial Sequence
  Definition of Artificial Sequence: Synthetic oligonucleotide
  CDS (2)..(130)
tggttccggtggtggtggttccatgtgcatgccgtgcttcaccaccgaccaccagatggctcgtaaatgcgacgactgctgcggtggtaaaggtcgtggtaaatgctacggtccgcagtgcctgtgccgt

SEQ ID NO: 869 - protein, 43 aa, Artificial Sequence
  Definition of Artificial Sequence: Synthetic peptide
GSGGGGSMCMPCFTTDHQMARKCDDCCGGKGRGKCYGPQCLCR

SEQ ID NO: 870 - DNA, 130 bp, Artificial Sequence
  Definition of Artificial Sequence: Synthetic oligonucleotide
caccacggcacaggcactgcggaccgtagcatttaccacgacctttaccaccgcagcagtcgtcgcatttacgagccatctggtggtcggtggtgaagcacggcatgcacatggaaccaccaccaccgga

SEQ ID NO: 871 - protein, 32 aa, Artificial Sequence
  Definition of Artificial Sequence: Synthetic peptide
VACVYRTCDKDCTSRKYRSGKCINNACKCYPY

SEQ ID NO: 872 - DNA, 92 bp, Artificial Sequence
  Definition of Artificial Sequence: Synthetic oligonucleotide
  CDS (22)..(81)
ggatccggaggaggaggaagctgctgcaacggccgccgcggctgcagcagccgctggtgccgcgaccacagccgctgctgctgagcggccgc

SEQ ID NO: 873 - protein, 20 aa, Artificial Sequence
  Definition of Artificial Sequence: Synthetic peptide
CCNGRRGCSSRWCRDHSRCC

SEQ ID NO: 874 - DNA, 60 bp, Artificial Sequence
  Definition of Artificial Sequence: Synthetic oligonucleotide
ggaggaggatccggaggaggaggaagctgctgcaacggccgccgcggctgcagcagccgc

SEQ ID NO: 875 - DNA, 61 bp, Artificial Sequence
  Definition of Artificial Sequence: Synthetic oligonucleotide
attattgcggccgctcagcagcagcggctgtggtcgcggcaccagcggctgctgcagccgc

SEQ ID NO: 876 - DNA, 88 bp, Artificial Sequence
  Definition of Artificial Sequence: Synthetic oligonucleotide
catggatccggaggaggaggaagcggcgtgatcatcaacgtgaagtgcaagatcagccgccagtgcctggagccctgcaagaaggccg

SEQ ID NO: 877 - DNA, 88 bp, Artificial Sequence
  Definition of Artificial Sequence: Synthetic oligonucleotide
catgcggccgcttactacttgggggtgcagtggcacttgccgttcatgcacttgccgaagcgcatgccggccttcttgcagggctcca

SEQ ID NO: 878 - DNA, 88 bp, Artificial Sequence
  Definition of Artificial Sequence: Synthetic oligonucleotide
catggatccggaggaggaggaagcggcgtgatcatcaacgtgagctgcaagatcagccgccagtgcctggagccctgcaagaaggccg

SEQ ID NO: 879 - DNA, 88 bp, Artificial Sequence; identical to SEQ ID NO: 877
  Definition of Artificial Sequence: Synthetic oligonucleotide

SEQ ID NO: 880 - DNA, 88 bp, Artificial Sequence
  Definition of Artificial Sequence: Synthetic oligonucleotide
catggatccggaggaggaggaagcggcgtgatcatcaacgtgaagtgcaagatcagccgccagtgcctgaagccctgcaaggacgccg

SEQ ID NO: 881 - DNA, 88 bp, Artificial Sequence
  Definition of Artificial Sequence: Synthetic oligonucleotide
catgcggccgcttactacttgggggtgcagtggcacttgccgttcatgcacttgccgaagcgcatgccggcgtccttgcagggcttca

SEQ ID NO: 882 - DNA, 88 bp, Artificial Sequence
  Definition of Artificial Sequence: Synthetic oligonucleotide
catggatccggaggaggaggaagcggcgtgatcatcaacgtgagctgcaagatcagccgccagtgcctgaagccctgcaaggacgccg

SEQ ID NO: 883 - DNA, 88 bp, Artificial Sequence; identical to SEQ ID NO: 881
  Definition of Artificial Sequence: Synthetic oligonucleotide

SEQ ID NO: 884 - protein, 35 aa, Artificial Sequence
  Definition of Artificial Sequence: Synthetic peptide
RSCIDTIPASRCTAFQCKHSMAYRLSFCRKTCGTC

SEQ ID NO: 885 - protein, 34 aa, Artificial Sequence
  Definition of Artificial Sequence: Synthetic peptide
SCIDTIPASRCTAFQCKHSMAYRLSFCRKTCGTC

SEQ ID NO: 886 - protein, 35 aa, Artificial Sequence
  Definition of Artificial Sequence: Synthetic peptide
RSCIDTIPVSRCTAFQCKHSMKYRLSFCRKTCGTC

SEQ ID NO: 887 - protein, 35 aa, Artificial Sequence
  Definition of Artificial Sequence: Synthetic peptide
RSCIDTIPVSRCTAFQCKHSMAYRLSFCRKTCGTC

SEQ ID NO: 888 - protein, 34 aa, Artificial Sequence
  Definition of Artificial Sequence: Synthetic peptide
SCIDTIPVSRCTAFQCKHSMKYRLSFCRKTCGTC

SEQ ID NO: 889 - protein, 34 aa, Artificial Sequence
  Definition of Artificial Sequence: Synthetic peptide
SCIDTIPVSRCTAFQCKHSMAYRLSFCRKTCGTC

SEQ ID NO: 890 - protein, 35 aa, Artificial Sequence
  Definition of Artificial Sequence: Synthetic peptide
RSCIDTIPESRCTAFQCKHSMAYRLSFCRKTCGTC

SEQ ID NO: 891 - protein, 34 aa, Artificial Sequence
  Definition of Artificial Sequence: Synthetic peptide
SCIDTIPESRCTAFQCKHSMAYRLSFCRKTCGTC

SEQ ID NO: 892 - protein, 35 aa, Artificial Sequence
  Definition of Artificial Sequence: Synthetic peptide
RSCIDTIPKSACTAFQCKHSMAYRLSFCRKTCGTC

SEQ ID NO: 893 - protein, 34 aa, Artificial Sequence
  Definition of Artificial Sequence: Synthetic peptide
SCIDTIPKSACTAFQCKHSMAYRLSFCRKTCGTC

SEQ ID NO: 894 - protein, 35 aa, Artificial Sequence
  Definition of Artificial Sequence: Synthetic peptide
RSCIDTIPKSECTAFQCKHSMAYRLSFCRKTCGTC

SEQ ID NO: 895 - protein, 34 aa, Artificial Sequence
  Definition of Artificial Sequence: Synthetic peptide
SCIDTIPKSECTAFQCKHSMAYRLSFCRKTCGTC

SEQ ID NO: 896 - protein, 35 aa, Artificial Sequence
  Definition of Artificial Sequence: Synthetic peptide
RSCIDTIPKSRCTDFQCKHSMKYRLSFCRKTCGTC

SEQ ID NO: 897 - protein, 35 aa, Artificial Sequence
  Definition of Artificial Sequence: Synthetic peptide
RSCIDTIPKSRCTDFQCKHSMAYRLSFCRKTCGTC

SEQ ID NO: 898 - protein, 34 aa, Artificial Sequence
  Definition of Artificial Sequence: Synthetic peptide
SCIDTIPKSRCTDFQCKHSMKYRLSFCRKTCGTC

SEQ ID NO: 899 - protein, 34 aa, Artificial Sequence
  Definition of Artificial Sequence: Synthetic peptide
SCIDTIPKSRCTDFQCKHSMAYRLSFCRKTCGTC

SEQ ID NO: 900 - protein, 35 aa, Artificial Sequence
  Definition of Artificial Sequence: Synthetic peptide
RSCIDTIPKSRCTAAQCKHSMAYRLSFCRKTCGTC

SEQ ID NO: 901 - protein, 34 aa, Artificial Sequence
  Definition of Artificial Sequence: Synthetic peptide
SCIDTIPKSRCTAAQCKHSMAYRLSFCRKTCGTC

SEQ ID NO: 902 - protein, 35 aa, Artificial Sequence
  Definition of Artificial Sequence: Synthetic peptide
RSCIDTIPKSRCTAIQCKHSMKYRLSFCRKTCGTC

SEQ ID NO: 903 - protein, 35 aa, Artificial Sequence
  Definition of Artificial Sequence: Synthetic peptide
RSCIDTIPKSRCTAIQCKHSMAYRLSFCRKTCGTC

SEQ ID NO: 904 - protein, 34 aa, Artificial Sequence
  Definition of Artificial Sequence: Synthetic peptide
SCIDTIPKSRCTAIQCKHSMKYRLSFCRKTCGTC

SEQ ID NO: 905 - protein, 34 aa, Artificial Sequence
  Definition of Artificial Sequence: Synthetic peptide
SCIDTIPKSRCTAIQCKHSMAYRLSFCRKTCGTC

SEQ ID NO: 906 - protein, 35 aa, Artificial Sequence
  Definition of Artificial Sequence: Synthetic peptide
RSCIDTIPKSRCTAVQCKHSMKYRLSFCRKTCGTC

SEQ ID NO: 907 - protein, 35 aa, Artificial Sequence
  Definition of Artificial Sequence: Synthetic peptide
RSCIDTIPKSRCTAVQCKHSMAYRLSFCRKTCGTC

SEQ ID NO: 908 - protein, 34 aa, Artificial Sequence
  Definition of Artificial Sequence: Synthetic peptide
SCIDTIPKSRCTAVQCKHSMKYRLSFCRKTCGTC

SEQ ID NO: 909 - protein, 34 aa, Artificial Sequence
  Definition of Artificial Sequence: Synthetic peptide
SCIDTIPKSRCTAVQCKHSMAYRLSFCRKTCGTC

SEQ ID NO: 910 - protein, 35 aa, Artificial Sequence
  Definition of Artificial Sequence: Synthetic peptide
RSCIDTIPKSRCTAFRCKHSMKYRLSFCRKTCGTC

SEQ ID NO: 911 - protein, 35 aa, Artificial Sequence
  Definition of Artificial Sequence: Synthetic peptide
RSCIDTIPKSRCTAFRCKHSMAYRLSFCRKTCGTC

SEQ ID NO: 912 - protein, 34 aa, Artificial Sequence
  Definition of Artificial Sequence: Synthetic peptide
SCIDTIPKSRCTAFRCKHSMKYRLSFCRKTCGTC

SEQ ID NO: 913 - protein, 34 aa, Artificial Sequence
  Definition of Artificial Sequence: Synthetic peptide
SCIDTIPKSRCTAFRCKHSMAYRLSFCRKTCGTC

SEQ ID NO: 914 - protein, 35 aa, Artificial Sequence
  Definition of Artificial Sequence: Synthetic peptide
RSCIDTIPKSRCTAFKCKHSMKYRLSFCRKTCGTC

SEQ ID NO: 915 - protein, 35 aa, Artificial Sequence
  Definition of Artificial Sequence: Synthetic peptide
RSCIDTIPKSRCTAFKCKHSMAYRLSFCRKTCGTC

SEQ ID NO: 916 - protein, 34 aa, Artificial Sequence
  Definition of Artificial Sequence: Synthetic peptide
SCIDTIPKSRCTAFKCKHSMKYRLSFCRKTCGTC

SEQ ID NO: 917 - protein, 34 aa, Artificial Sequence
  Definition of Artificial Sequence: Synthetic peptide
SCIDTIPKSRCTAFKCKHSMAYRLSFCRKTCGTC

SEQ ID NO: 918 - protein, 35 aa, Artificial Sequence
  Definition of Artificial Sequence: Synthetic peptide
RSCIDTIPASECTAFQCKHSMKYRLSFCRKTCGTC

SEQ ID NO: 919 - protein, 35 aa, Artificial Sequence
  Definition of Artificial Sequence: Synthetic peptide
RSCIDTIPASECTAFQCKHSMAYRLSFCRKTCGTC

SEQ ID NO: 920 - protein, 34 aa, Artificial Sequence
  Definition of Artificial Sequence: Synthetic peptide
SCIDTIPASECTAFQCKHSMKYRLSFCRKTCGTC

SEQ ID NO: 921 - protein, 34 aa, Artificial Sequence
  Definition of Artificial Sequence: Synthetic peptide
SCIDTIPASECTAFQCKHSMAYRLSFCRKTCGTC

SEQ ID NO: 922 - protein, 35 aa, Artificial Sequence
  Definition of Artificial Sequence: Synthetic peptide
RSCIDTIPVSECTAFQCKHSMKYRLSFCRKTCGTC

SEQ ID NO: 923 - protein, 35 aa, Artificial Sequence
  Definition of Artificial Sequence: Synthetic peptide
RSCIDTIPVSECTAFQCKHSMAYRLSFCRKTCGTC

SEQ ID NO: 924 - protein, 34 aa, Artificial Sequence
  Definition of Artificial Sequence: Synthetic peptide
SCIDTIPVSECTAFQCKHSMKYRLSFCRKTCGTC

SEQ ID NO: 925 - protein, 34 aa, Artificial Sequence
  Definition of Artificial Sequence: Synthetic peptide
SCIDTIPVSECTAFQCKHSMAYRLSFCRKTCGTC

SEQ ID NO: 926 - protein, 35 aa, Artificial Sequence
  Definition of Artificial Sequence: Synthetic peptide
RSCIDTIPVSACTAFQCKHSMKYRLSFCRKTCGTC

SEQ ID NO: 927 - protein, 35 aa, Artificial Sequence
  Definition of Artificial Sequence: Synthetic peptide
RSCIDTIPVSACTAFQCKHSMAYRLSFCRKTCGTC

SEQ ID NO: 928 - protein, 34 aa, Artificial Sequence
  Definition of Artificial Sequence: Synthetic peptide
SCIDTIPVSACTAFQCKHSMKYRLSFCRKTCGTC

SEQ ID NO: 929 - protein, 34 aa, Artificial Sequence
  Definition of Artificial Sequence: Synthetic peptide
SCIDTIPVSACTAFQCKHSMAYRLSFCRKTCGTC

SEQ ID NO: 930 - protein, 35 aa, Artificial Sequence
  Definition of Artificial Sequence: Synthetic peptide
RSCIDTIPASACTAFQCKHSMKYRLSFCRKTCGTC

SEQ ID NO: 931 - protein, 35 aa, Artificial Sequence
  Definition of Artificial Sequence: Synthetic peptide
RSCIDTIPASACTAFQCKHSMAYRLSFCRKTCGTC

SEQ ID NO: 932 - protein, 34 aa, Artificial Sequence
  Definition of Artificial Sequence: Synthetic peptide
SCIDTIPASACTAFQCKHSMKYRLSFCRKTCGTC

SEQ ID NO: 933 - protein, 34 aa, Artificial Sequence
  Definition of Artificial Sequence: Synthetic peptide
SCIDTIPASACTAFQCKHSMAYRLSFCRKTCGTC

SEQ ID NO: 934 - protein, 35 aa, Artificial Sequence
  Definition of Artificial Sequence: Synthetic peptide
RSCIDTIPKSECTDIRCKHSMKYRLSFCRKTCGTC

SEQ ID NO: 935 - protein, 35 aa, Artificial Sequence
  Definition of Artificial Sequence: Synthetic peptide
RSCIDTIPKSECTDIRCKHSMAYRLSFCRKTCGTC

SEQ ID NO: 936 - protein, 34 aa, Artificial Sequence
  Definition of Artificial Sequence: Synthetic peptide
SCIDTIPKSECTDIRCKHSMKYRLSFCRKTCGTC

SEQ ID NO: 937 - protein, 34 aa, Artificial Sequence
  Definition of Artificial Sequence: Synthetic peptide
SCIDTIPKSECTDIRCKHSMAYRLSFCRKTCGTC

SEQ ID NO: 938 - protein, 35 aa, Artificial Sequence
  Definition of Artificial Sequence: Synthetic peptide
RSCIDTIPVSECTDIRCKHSMKYRLSFCRKTCGTC

SEQ ID NO: 939 - protein, 35 aa, Artificial Sequence
  Definition of Artificial Sequence: Synthetic peptide
RSCIDTIPVSECTDIRCKHSMAYRLSFCRKTCGTC

SEQ ID NO: 940 - protein, 34 aa, Artificial Sequence
  Definition of Artificial Sequence: Synthetic peptide
SCIDTIPVSECTDIRCKHSMKYRLSFCRKTCGTC

SEQ ID NO: 941 - protein, 34 aa, Artificial Sequence
  Definition of Artificial Sequence: Synthetic peptide
SCIDTIPVSECTDIRCKHSMAYRLSFCRKTCGTC

SEQ ID NO: 942 - protein, 35 aa, Artificial Sequence
  Definition of Artificial Sequence: Synthetic peptide
RSCIDTIPVSECTDIQCKHSMKYRLSFCRKTCGTC

SEQ ID NO: 943 - protein, 35 aa, Artificial Sequence
  Definition of Artificial Sequence: Synthetic peptide
RSCIDTIPVSECTDIQCKHSMAYRLSFCRKTCGTC

SEQ ID NO: 944 - protein, 34 aa, Artificial Sequence
  Definition of Artificial Sequence: Synthetic peptide
SCIDTIPVSECTDIQCKHSMKYRLSFCRKTCGTC

SEQ ID NO: 945 - protein, 34 aa, Artificial Sequence
  Definition of Artificial Sequence: Synthetic peptide
SCIDTIPVSECTDIQCKHSMAYRLSFCRKTCGTC

SEQ ID NO: 946 - protein, 35 aa, Artificial Sequence
  Definition of Artificial Sequence: Synthetic peptide
RTCKDLIPVSECTDIRCKHSMKYRLSFCRKTCGTC

SEQ ID NO: 947 - protein, 35 aa, Artificial Sequence
  Definition of Artificial Sequence: Synthetic peptide
RTCKDLIPVSECTDIRCKHSMAYRLSFCRKTCGTC

SEQ ID NO: 948 - protein, 34 aa, Artificial Sequence
  Definition of Artificial Sequence: Synthetic peptide
TCKDLIPVSECTDIRCKHSMKYRLSFCRKTCGTC

SEQ ID NO: 949 - protein, 34 aa, Artificial Sequence
  Definition of Artificial Sequence: Synthetic peptide
TCKDLIPVSECTDIRCKHSMAYRLSFCRKTCGTC

SEQ ID NO: 950 - protein, 40 aa, Artificial Sequence
  Definition of Artificial Sequence: Synthetic peptide
  MOD_RES (1)..(1): phosphotyrosine
XAEEARSCIDTIPKSRCTAFQCKHSMKYRLSFCRKTCGTC

SEQ ID NO: 951 - DNA, 888 bp, Artificial Sequence
  Definition of Artificial Sequence: Synthetic construct
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgaagtgcaagatcagccgccagtgcctggagccctgcaagaaggccggcatgcgcttcggcaagtgcatgaacggcaagtgccactgcacccccaagtagtaa

SEQ ID NO: 952 - protein, 294 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVKCKISRQCLEPCKKAGMRFGKCMNGKCHCTPK

SEQ ID NO: 953 - DNA, 888 bp, Artificial Sequence
  Definition of Artificial Sequence: Synthetic construct
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgagctgcaagatcagccgccagtgcctggagccctgcaagaaggccggcatgcgcttcggcaagtgcatgaacggcaagtgccactgcacccccaagtagtaa

SEQ ID NO: 954 - protein, 294 aa, Artificial Sequence [sequence omitted]

SEQ ID NO: 955 - DNA, 888 bp, Artificial Sequence
  Definition of Artificial Sequence: Synthetic construct
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgaagtgcaagatcagccgccagtgcctgaagccctgcaaggacgccggcatgcgcttcggcaagtgcatgaacggcaagtgccactgcacccccaagtagtaa

SEQ ID NO: 956 - protein, 294 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVKCKISRQCLKPCKDAGMRFGKCMNGKCHCTPK

SEQ ID NO: 957 - DNA, 888 bp, Artificial Sequence
  Definition of Artificial Sequence: Synthetic construct
  CDS (1)..(888)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcggcgtgatcatcaacgtgagctgcaagatcagccgccagtgcctgaagccctgcaaggacgccggcatgcgcttcggcaagtgcatgaacggcaagtgccactgcacccccaagtagtaa

SEQ ID NO: 958 - protein, 294 aa, Artificial Sequence
  Definition of Artificial Sequence: Synthetic protein
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSGVIINVSCKISRQCLKPCKDAGMRFGKCMNGKCHCTPK

SEQ ID NO: 959 - protein, 48 aa, Artificial Sequence
  Definition of Artificial Sequence: Synthetic peptide
KKKCIAKDYGRCKWGGTPCCRGRGCICSIMGTNCECKPRLIMEGLGLA

SEQ ID NO: 960 - protein, 48 aa, Artificial Sequence
  Definition of Artificial Sequence: Synthetic peptide
EDNCIAEDYGKCTWGGTKCCRGRPCRCSMIGTNCECTPRLIMEGLSFA

SEQ ID NO: 961 - protein, 76 aa, Artificial Sequence
  Definition of Artificial Sequence: Synthetic peptide
SCIDIGGDCDGEKDDCQCCRRNGYCSCYSLFGYLKSGCKCVVGTSAEFQGICRRKARQCYNSDPDKCESHNKPKRR

SEQ ID NO: 962 - protein, 76 aa, Artificial Sequence
  Definition of Artificial Sequence: Synthetic peptide
SCIDIGGDCDGEKDDCQCCRRNGYCSCYSLFGYLKSGCKCVVGTSAEFQGICRRKARTCYNSDPDKCESHNKPKRR

SEQ ID NO: 963 - protein, 76 aa, Artificial Sequence
  Definition of Artificial Sequence: Synthetic peptide
SCIDFGGDCDGEKDDCQCCRSNGYCSCYSLFGYLKSGCKCEVGTSAEFRRICRRKAKQCYNSDPDKCVSVYKPKRR

SEQ ID NO: 964 - protein, 76 aa, Artificial Sequence
  Definition of Artificial Sequence: Synthetic peptide
SCIDFGGDCDGEKDDCQCCRSNGYCSCYNLFGYLKSGCKCEVGTSAEFRRICRRKAKQCYNSDPDKCVSVYKPKRR

SEQ ID NO: 965 - protein, 76 aa, Artificial Sequence
  Definition of Artificial Sequence: Synthetic peptide
SCIDFGGDCDGEKDDCQCCRSNGYCSCYNLFGYLRSGCKCEVGTSAEFRRICRRKAKQCYNSDPDKCVSVYKPKRR

SEQ ID NO: 966 - protein, 43 aa, Artificial Sequence
  Definition of Artificial Sequence: Synthetic peptide
  MOD_RES (20)..(20): variable naturally occurring amino acid
  MOD_RES (40)..(40): variable naturally occurring amino acid
NCIDFGGDCDGEKDDCQCCXRNGYCSCYNLFGYLKRGCKXEVG

SEQ ID NO: 967 - protein, 37 aa, Artificial Sequence
  Definition of Artificial Sequence: Synthetic peptide
  MOD_RES (27)..(27): variable naturally occurring amino acid
  MOD_RES (29)..(29): variable naturally occurring amino acid
SCIKIGEDCDGDKDDCQCCRTNGYCSXYXLFGYLKSG

SEQ ID NO: 968 - protein, 28 aa, Artificial Sequence
  Definition of Artificial Sequence: Synthetic peptide
GCIEIGGDCDGYQEKSYCQCCRNNGFCS

SEQ ID NO: 969 - protein, 66 aa, Artificial Sequence
  Definition of Artificial Sequence: Synthetic peptide
AKALPPGSVCDGNESDCKCYGKWHKCRCPWKWHFTGEGPCTCEKGMKHTCITKLHCPNKAEWGLDW

SEQ ID NO: 970 - protein, 37 aa, Artificial Sequence
  Definition of Artificial Sequence: Synthetic peptide
  MOD_RES (37)..(37): variable naturally occurring amino acid
ECVPENGHCRDWYDECCEGFYCSCRQPPKCICRNNNX

SEQ ID NO: 971 - protein, 37 aa, Artificial Sequence
  Definition of Artificial Sequence: Synthetic peptide
DCVGESQQCADWAGPHCCDGYYCTCRYFPKCICVNNN

SEQ ID NO: 972 - protein, 37 aa, Artificial Sequence
  Definition of Artificial Sequence: Synthetic peptide
ACVGENKQCADWAGPHCCDGYYCTCRYFPKCICRNNN

SEQ ID NO: 973 - protein, 37 aa, Artificial Sequence
  Definition of Artificial Sequence: Synthetic peptide
ACVGENQQCADWAGPHCCDGYYCTCRYFPKCICRNNN

SEQ ID NO: 974 - protein, 37 aa, Artificial Sequence
  Definition of Artificial Sequence: Synthetic peptide
ECATKNKRCADWAGPWCCDGLYCSCRSYPGCMCRPSS

SEQ ID NO: 975 - protein, 36 aa, Artificial Sequence
  Definition of Artificial Sequence: Synthetic peptide
ECVPENGHCRDWYDECCEGFYCSCRQPPKCICRNNN

SEQ ID NO: 976 - protein, 270 aa, Artificial Sequence
  Definition of Artificial Sequence: Synthetic protein
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGGVIINVKCKISRQCLEPCKKAGMRFGKCMNGKCHCTPKGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 977 - protein, 267 aa, Artificial Sequence
  Definition of Artificial Sequence: Synthetic protein
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGRSCIDTIPKSRCTAFQCKHSMKYRLSFCRKTCGTCGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 978 - protein, 269 aa, Artificial Sequence
  Definition of Artificial Sequence: Synthetic protein
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGRSCIDTIPKSRCTAFQCKHSMKYRLSFCRKTCGTCGGGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 979 - protein, 272 aa, Artificial Sequence
  Definition of Artificial Sequence: Synthetic protein
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELGGGGGVIINVKCKISRQCLEPCKKAGMRFGKCMNGKCHCTPKGGTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 980 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCHCTPK

SEQ ID NO: 981 - protein, 38 aa, Artificial Sequence; identical to SEQ ID NO: 980
  Definition of Artificial Sequence: Synthetic peptide
  MOD_RES (16)..(16): hLys

SEQ ID NO: 982 - protein, 38 aa, Artificial Sequence; identical to SEQ ID NO: 980
  Definition of Artificial Sequence: Synthetic peptide
  MOD_RES (16)..(16): hArg

SEQ ID NO: 983 - protein, 38 aa, Artificial Sequence; identical to SEQ ID NO: 980
  Definition of Artificial Sequence: Synthetic peptide
  MOD_RES (16)..(16): Cit

SEQ ID NO: 984 - protein, 38 aa, Artificial Sequence; identical to SEQ ID NO: 980
  Definition of Artificial Sequence: Synthetic peptide
  MOD_RES (16)..(16): hCit

SEQ ID NO: 985 - protein, 38 aa, Artificial Sequence; identical to SEQ ID NO: 980
  Definition of Artificial Sequence: Synthetic peptide
  MOD_RES (16)..(16): Dpr

SEQ ID NO: 986 - protein, 38 aa, Artificial Sequence; identical to SEQ ID NO: 980
  Definition of Artificial Sequence: Synthetic peptide
  MOD_RES (16)..(16): Dab

SEQ ID NO: 987 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCHCYPK

SEQ ID NO: 988 - protein, 38 aa, Artificial Sequence; identical to SEQ ID NO: 987
  Definition of Artificial Sequence: Synthetic peptide
  MOD_RES (16)..(16): hLys

SEQ ID NO: 989 - protein, 38 aa, Artificial Sequence; identical to SEQ ID NO: 987
  Definition of Artificial Sequence: Synthetic peptide
  MOD_RES (16)..(16): hArg

SEQ ID NO: 990 - protein, 38 aa, Artificial Sequence; identical to SEQ ID NO: 987
  Definition of Artificial Sequence: Synthetic peptide
  MOD_RES (16)..(16): Cit

SEQ ID NO: 991 - protein, 38 aa, Artificial Sequence; identical to SEQ ID NO: 987
  Definition of Artificial Sequence: Synthetic peptide
  MOD_RES (16)..(16): hCit

SEQ ID NO: 992 - protein, 38 aa, Artificial Sequence; identical to SEQ ID NO: 987
  Definition of Artificial Sequence: Synthetic peptide
  MOD_RES (16)..(16): Dpr

SEQ ID NO: 993 - protein, 38 aa, Artificial Sequence; identical to SEQ ID NO: 987
  Definition of Artificial Sequence: Synthetic peptide
  MOD_RES (16)..(16): Dab

SEQ ID NO: 994 - protein, 38 aa, Artificial Sequence
  Definition of Artificial Sequence: Synthetic peptide
GVIINVKCKISRQCLKPCKDAGMRFGKCMNGKCACYPK

SEQ ID NO: 995 - protein, 38 aa, Artificial Sequence
  Definition of Artificial Sequence: Synthetic peptide
GVIINVKCKISRQCLKPCKDAGMRFGKCMNGKCGCYPK

SEQ ID NO: 996 - protein, 38 aa, Artificial Sequence
  Definition of Artificial Sequence: Synthetic peptide
GVIINVKCKISRQCLKPCKDAGMRFGKCMNGKCACFPK

SEQ ID NO: 997 - protein, 38 aa, Artificial Sequence
  Definition of Artificial Sequence: Synthetic peptide
GVIINVKCKISRQCLKPCKDAGMRFGKCMNGKCACWPK

SEQ ID NO: 998 - protein, 38 aa, Artificial Sequence
  Definition of Artificial Sequence: Synthetic peptide
GVIINVKCKISRQCLKPCKEAGMRFGKCMNGKCACYPK

SEQ ID NO: 999 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCACTPK

SEQ ID NO: 1000 - protein, 38 aa, Artificial Sequence; identical to SEQ ID NO: 999
  Definition of Artificial Sequence: Synthetic peptide
  MOD_RES (16)..(16): hLys

SEQ ID NO: 1001 - protein, 38 aa, Artificial Sequence; identical to SEQ ID NO: 999
  Definition of Artificial Sequence: Synthetic peptide
  MOD_RES (16)..(16): hArg

SEQ ID NO: 1002 - protein, 38 aa, Artificial Sequence; identical to SEQ ID NO: 999
  Definition of Artificial Sequence: Synthetic peptide
  MOD_RES (16)..(16): Cit

SEQ ID NO: 1003 - protein, 38 aa, Artificial Sequence; identical to SEQ ID NO: 980
  Definition of Artificial Sequence: Synthetic peptide
  MOD_RES (16)..(16): hCit

SEQ ID NO: 1004 - protein, 40 aa, Artificial Sequence
  Definition of Artificial Sequence: Synthetic peptide
  MOD_RES (16)..(16): Dpr
GVIINVKCKISRQCLXPRPCKDAGMRFGKCMNGKCACTPK

SEQ ID NO: 1005 - protein, 38 aa, Artificial Sequence; identical to SEQ ID NO: 999
  Definition of Artificial Sequence: Synthetic peptide
  MOD_RES (16)..(16): Dab

SEQ ID NO: 1006 - protein, 35 aa, Artificial Sequence
  Definition of Artificial Sequence: Synthetic peptide
  MOD_RES (16)..(16): Orn
GVIINVKCKISRQCLXPCKDAGMRFGKCMNGKCHC

SEQ ID NO: 1007 - protein, 35 aa, Artificial Sequence; identical to SEQ ID NO: 1006
  Definition of Artificial Sequence: Synthetic peptide
  MOD_RES (16)..(16): hLys

SEQ ID NO: 1008 - protein, 35 aa, Artificial Sequence; identical to SEQ ID NO: 1006
  Definition of Artificial Sequence: Synthetic peptide
  MOD_RES (16)..(16): hArg

SEQ ID NO: 1009 - protein, 35 aa, Artificial Sequence; identical to SEQ ID NO: 1006
  Definition of Artificial Sequence: Synthetic peptide
  MOD_RES (16)..(16): Cit

SEQ ID NO: 1010 - protein, 35 aa, Artificial Sequence; identical to SEQ ID NO: 1006
  Definition of Artificial Sequence: Synthetic peptide
  MOD_RES (16)..(16): hCit

SEQ ID NO: 1011 - protein, 35 aa, Artificial Sequence; identical to SEQ ID NO: 1006
  Definition of Artificial Sequence: Synthetic peptide
  MOD_RES (16)..(16): Dpr

SEQ ID NO: 1012 - protein, 35 aa, Artificial Sequence; identical to SEQ ID NO: 1006
  Definition of Artificial Sequence: Synthetic peptide
  MOD_RES (16)..(16): Dab

SEQ ID NO: 1013 - protein, 35 aa, Artificial Sequence
  Definition of Artificial Sequence: Synthetic peptide
  MOD_RES (16)..(16): Orn
GVIINVKCKISRQCLXPCKDAGMRFGKCMNGKCAC

SEQ ID NO: 1014 - protein, 35 aa, Artificial Sequence; identical to SEQ ID NO: 1013
  Definition of Artificial Sequence: Synthetic peptide
  MOD_RES (16)..(16): hLys

SEQ ID NO: 1015 - protein, 35 aa, Artificial Sequence; identical to SEQ ID NO: 1013
  Definition of Artificial Sequence: Synthetic peptide
  MOD_RES (16)..(16): hArg

SEQ ID NO: 1016 - protein, 35 aa, Artificial Sequence; identical to SEQ ID NO: 1013
  Definition of Artificial Sequence: Synthetic peptide
  MOD_RES (16)..(16): Cit

SEQ ID NO: 1017 - protein, 35 aa, Artificial Sequence; identical to SEQ ID NO: 1006
  Definition of Artificial Sequence: Synthetic peptide
  MOD_RES (16)..(16): hCit

SEQ ID NO: 1018 - protein, 35 aa, Artificial Sequence; identical to SEQ ID NO: 1013
  Definition of Artificial Sequence: Synthetic peptide
  MOD_RES (16)..(16): Dpr

SEQ ID NO: 1019 - protein, 35 aa, Artificial Sequence; identical to SEQ ID NO: 1013
  Definition of Artificial Sequence: Synthetic peptide
  MOD_RES (16)..(16): Dab

SEQ ID NO: 1020 - protein, 38 aa, Artificial Sequence
  Definition of Artificial Sequence: Synthetic peptide
GVIINVKCKISRQCLKPCKDAGMRFGKCMNGKCGCYGG

SEQ ID NO: 1021 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCHCYGG

SEQ ID NO: 1022 - protein, 38 aa, Artificial Sequence; identical to SEQ ID NO: 1021
  Definition of Artificial Sequence: Synthetic peptide
  MOD_RES (16)..(16): hLys

SEQ ID NO: 1023 - protein, 38 aa, Artificial Sequence; identical to SEQ ID NO: 1021
  Definition of Artificial Sequence: Synthetic peptide
  MOD_RES (16)..(16): hArg

SEQ ID NO: 1024 - protein, 38 aa, Artificial Sequence; identical to SEQ ID NO: 1021
  Definition of Artificial Sequence: Synthetic peptide
  MOD_RES (16)..(16): Cit

SEQ ID NO: 1025 - protein, 38 aa, Artificial Sequence; identical to SEQ ID NO: 1021
  Definition of Artificial Sequence: Synthetic peptide
  MOD_RES (16)..(16): hCit

SEQ ID NO: 1026 - protein, 38 aa, Artificial Sequence; identical to SEQ ID NO: 1021
  Definition of Artificial Sequence: Synthetic peptide
  MOD_RES (16)..(16): Dpr

SEQ ID NO: 1027 - protein, 38 aa, Artificial Sequence
  Definition of Artificial Sequence: Synthetic peptide
GVIINVKCKISRQCLKPCKDAGMRFGKCMNGKCACYGG

SEQ ID NO: 1028 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCACYGG

SEQ ID NO: 1029 - protein, 38 aa, Artificial Sequence; identical to SEQ ID NO: 1028
  Definition of Artificial Sequence: Synthetic peptide
  MOD_RES (16)..(16): hLys

SEQ ID NO: 1030 - protein, 38 aa, Artificial Sequence; identical to SEQ ID NO: 1028
  Definition of Artificial Sequence: Synthetic peptide
  MOD_RES (16)..(16): hArg

SEQ ID NO: 1031 - protein, 38 aa, Artificial Sequence; identical to SEQ ID NO: 1028
  Definition of Artificial Sequence: Synthetic peptide
  MOD_RES (16)..(16): Cit

SEQ ID NO: 1032 - protein, 38 aa, Artificial Sequence; identical to SEQ ID NO: 1021
  Definition of Artificial Sequence: Synthetic peptide
  MOD_RES (16)..(16): hCit

SEQ ID NO: 1033 - protein, 38 aa, Artificial Sequence; identical to SEQ ID NO: 1028
  Definition of Artificial Sequence: Synthetic peptide
  MOD_RES (16)..(16): Dpr

SEQ ID NO: 1034 - protein, 38 aa, Artificial Sequence; identical to SEQ ID NO: 1028
  Definition of Artificial Sequence: Synthetic peptide
  MOD_RES (16)..(16): Dab

SEQ ID NO: 1035 - protein, 37 aa, Artificial Sequence
  Definition of Artificial Sequence: Synthetic peptide
GVIINVKCKISRQCLKPCKDAGMRFGKCMNGKCACYG

SEQ ID NO: 1036 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCHCGGG

SEQ ID NO: 1037 - protein, 38 aa, Artificial Sequence; identical to SEQ ID NO: 1036
  Definition of Artificial Sequence: Synthetic peptide
  MOD_RES (16)..(16): hLys

SEQ ID NO: 1038 - protein, 38 aa, Artificial Sequence; identical to SEQ ID NO: 1036
  Definition of Artificial Sequence: Synthetic peptide
  MOD_RES (16)..(16): hArg

SEQ ID NO: 1039 - protein, 38 aa, Artificial Sequence; identical to SEQ ID NO: 1036
  Definition of Artificial Sequence: Synthetic peptide
  MOD_RES (16)..(16): Cit

SEQ ID NO: 1040 - protein, 38 aa, Artificial Sequence; identical to SEQ ID NO: 1036
  Definition of Artificial Sequence: Synthetic peptide
  MOD_RES (16)..(16): hCit

SEQ ID NO: 1041 - protein, 38 aa, Artificial Sequence; identical to SEQ ID NO: 1036
  Definition of Artificial Sequence: Synthetic peptide
  MOD_RES (16)..(16): Dpr

SEQ ID NO: 1042 - protein, 38 aa, Artificial Sequence
  Definition of Artificial Sequence: Synthetic peptide
GVIINVKCKISRQCLKPCKDAGMRFGKCMNGKCACFGG

SEQ ID NO: 1043 - protein, 38 aa, Artificial Sequence
  Definition of Artificial Sequence: Synthetic peptide
  MOD_RES (16)..(16): Orn
GVIINVKCKISRQCLXPCKDAGMRFGKCMNGKCACGGG

SEQ ID NO: 1044 - protein, 38 aa, Artificial Sequence; identical to SEQ ID NO: 1043
  Definition of Artificial Sequence: Synthetic peptide
  MOD_RES (16)..(16): hLys

SEQ ID NO: 1045 - protein, 38 aa, Artificial Sequence; identical to SEQ ID NO: 1043
  Definition of Artificial Sequence: Synthetic peptide
  MOD_RES (16)..(16): hArg

SEQ ID NO: 1046 - protein, 38 aa, Artificial Sequence; identical to SEQ ID NO: 1043
  Definition of Artificial Sequence: Synthetic peptide
  MOD_RES (16)..(16): Cit

SEQ ID NO: 1047 - protein, 38 aa, Artificial Sequence; identical to SEQ ID NO: 1043
  Definition of Artificial Sequence: Synthetic peptide
  MOD_RES (16)..(16): hCit

SEQ ID NO: 1048 - protein, 38 aa, Artificial Sequence; identical to SEQ ID NO: 1043
  Definition of Artificial Sequence: Synthetic peptide
  MOD_RES (16)..(16): Dpr

SEQ ID NO: 1049 - protein, 38 aa, Artificial Sequence; identical to SEQ ID NO: 1043
  Definition of Artificial Sequence: Synthetic peptide
  MOD_RES (16)..(16): Dab

SEQ ID NO: 1050 - protein, 37 aa, Artificial Sequence
  Definition of Artificial Sequence: Synthetic peptide
GVIINVKCKISRQCLKPCKDAGMRFGKCMNGKCACGG

SEQ ID NO: 1051 - protein, 37 aa, Artificial Sequence; identical to SEQ ID NO: 1035
  Definition of Artificial Sequence: Synthetic peptide

SEQ ID NO: 1052 - protein, 37 aa, Artificial Sequence
  Definition of Artificial Sequence: Synthetic peptide
  MOD_RES (16)..(16): Orn
GVIINVKCKISRQCLXPCKDAGMRFGKCMNGKCACGG

SEQ ID NO: 1053 - protein, 38 aa, Artificial Sequence
  Definition of Artificial Sequence: Synthetic peptide
  MOD_RES (16)..(16): hLys
GVIINVKCKISRQCLXPCKEAGMRFGKCMNGKCHCTPK

SEQ ID NO: 1054 - protein, 38 aa, Artificial Sequence; identical to SEQ ID NO: 1053
  Definition of Artificial Sequence: Synthetic peptide
  MOD_RES (16)..(16): hArg

SEQ ID NO: 1055 - protein, 38 aa, Artificial Sequence; identical to SEQ ID NO: 1053
  Definition of Artificial Sequence: Synthetic peptide
  MOD_RES (16)..(16): Cit

SEQ ID NO: 1056 - protein, 38 aa, Artificial Sequence; identical to SEQ ID NO: 1053
  Definition of Artificial Sequence: Synthetic peptide
  MOD_RES (16)..(16): hCit

SEQ ID NO: 1057 - protein, 38 aa, Artificial Sequence; identical to SEQ ID NO: 1053
  Definition of Artificial Sequence: Synthetic peptide
  MOD_RES (16)..(16): Dpr

SEQ ID NO: 1058 - protein, 38 aa, Artificial Sequence; identical to SEQ ID NO: 1053
  Definition of Artificial Sequence: Synthetic peptide
  MOD_RES (16)..(16): Dab

SEQ ID NO: 1059 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCHCYPK

SEQ ID NO: 1060 - protein, 38 aa, Artificial Sequence; identical to SEQ ID NO: 1059
  Definition of Artificial Sequence: Synthetic peptide
  MOD_RES (16)..(16): hLys

SEQ ID NO: 1061 - protein, 38 aa, Artificial Sequence; identical to SEQ ID NO: 1059
  Definition of Artificial Sequence: Synthetic peptide
  MOD_RES (16)..(16): hArg

SEQ ID NO: 1062 - protein, 38 aa, Artificial Sequence; identical to SEQ ID NO: 1059
  Definition of Artificial Sequence: Synthetic peptide
  MOD_RES (16)..(16): Cit

SEQ ID NO: 1063 - protein, 38 aa, Artificial Sequence; identical to SEQ ID NO: 1059
  Definition of Artificial Sequence: Synthetic peptide
  MOD_RES (16)..(16): hCit

SEQ ID NO: 1064 - protein, 38 aa, Artificial Sequence; identical to SEQ ID NO: 1059
  Definition of Artificial Sequence: Synthetic peptide
  MOD_RES (16)..(16): Dpr

SEQ ID NO: 1065 - protein, 38 aa, Artificial Sequence; identical to SEQ ID NO: 1059
  Definition of Artificial Sequence: Synthetic peptide
  MOD_RES (16)..(16): Dab

SEQ ID NO: 1066 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCACTPK

SEQ ID NO: 1067 - protein, 38 aa, Artificial Sequence; identical to SEQ ID NO: 1066
  Definition of Artificial Sequence: Synthetic peptide
  MOD_RES (16)..(16): hLys

SEQ ID NO: 1068 - protein, 38 aa, Artificial Sequence; identical to SEQ ID NO: 1066
  Definition of Artificial Sequence: Synthetic peptide
  MOD_RES (16)..(16): hArg

SEQ ID NO: 1069 - protein, 38 aa, Artificial Sequence; identical to SEQ ID NO: 1066
  Definition of Artificial Sequence: Synthetic peptide
  MOD_RES (16)..(16): Cit

SEQ ID NO: 1070 - protein, 38 aa, Artificial Sequence; identical to SEQ ID NO: 1053
  Definition of Artificial Sequence: Synthetic peptide
  MOD_RES (16)..(16): hCit

SEQ ID NO: 1071 - protein, 38 aa, Artificial Sequence; identical to SEQ ID NO: 1066
  Definition of Artificial Sequence: Synthetic peptide
  MOD_RES (16)..(16): Dpr

SEQ ID NO: 1072 - protein, 38 aa, Artificial Sequence; identical to SEQ ID NO: 1066
  Definition of Artificial Sequence: Synthetic peptide
  MOD_RES (16)..(16): Dab

SEQ ID NO: 1073 - protein, 35 aa, Artificial Sequence
  Definition of Artificial Sequence: Synthetic peptide
  MOD_RES (16)..(16): Orn
GVIINVKCKISRQCLXPCKEAGMRFGKCMNGKCHC

SEQ ID NO: 1074 - protein, 35 aa, Artificial Sequence; identical to SEQ ID NO: 1073
  Definition of Artificial Sequence: Synthetic peptide
  MOD_RES (16)..(16): hLys

SEQ ID NO: 1075 - protein, 35 aa, Artificial Sequence; identical to SEQ ID NO: 1073
  Definition of Artificial Sequence: Synthetic peptide
  MOD_RES (16)..(16): hArg

SEQ ID NO: 1076 - protein, 35 aa, Artificial Sequence; identical to SEQ ID NO: 1073
  Definition of Artificial Sequence: Synthetic peptide
  MOD_RES (16)..(16): Cit

SEQ ID NO: 1077 - protein, 35 aa, Artificial Sequence; identical to SEQ ID NO: 1073
  Definition of Artificial Sequence: Synthetic peptide
  MOD_RES (16)..(16): hCit

SEQ ID NO: 1078 - protein, 35 aa, Artificial Sequence; identical to SEQ ID NO: 1073
  Definition of Artificial Sequence: Synthetic peptide
  MOD_RES (16)..(16): Dpr

SEQ ID NO: 1079 - protein, 35 aa, Artificial Sequence
  Definition of Artificial Sequence: Synthetic peptide
  MOD_RES (16)..(16): Orn
GVIINVKCKISRQCLXPCKEAGMRFGKCMNGKCAC

SEQ ID NO: 1080 - protein, 35 aa, Artificial Sequence; identical to SEQ ID NO: 1079
  Definition of Artificial Sequence: Synthetic peptide
  MOD_RES (16)..(16): hLys

SEQ ID NO: 1081 - protein, 35 aa, Artificial Sequence; identical to SEQ ID NO: 1079
  Definition of Artificial Sequence: Synthetic peptide
  MOD_RES (16)..(16): hArg

SEQ ID NO: 1082 - protein, 35 aa, Artificial Sequence; identical to SEQ ID NO: 1079
  Definition of Artificial Sequence: Synthetic peptide
  MOD_RES (16)..(16): Cit

SEQ ID NO: 1083 - protein, 35 aa, Artificial Sequence; identical to SEQ ID NO: 1073
  Definition of Artificial Sequence: Synthetic peptide
  MOD_RES (16)..(16): hCit

SEQ ID NO: 1084 - protein, 35 aa, Artificial Sequence; identical to SEQ ID NO: 1079
  Definition of Artificial Sequence: Synthetic peptide
  MOD_RES (16)..(16): Dpr

SEQ ID NO: 1085 - protein, 35 aa, Artificial Sequence; identical to SEQ ID NO: 1079
  Definition of Artificial Sequence: Synthetic peptide
  MOD_RES (16)..(16): Dab

SEQ ID NO: 1086 - protein, 38 aa, Artificial Sequence
  Definition of Artificial Sequence: Synthetic peptide
GVIINVKCKISRQCLKPCKEAGMRFGKCMNGKCHCYGG

SEQ ID NO: 1087 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCHCYGG

SEQ ID NO: 1088 - protein, 37 aa, Artificial Sequence
  Definition of Artificial Sequence: Synthetic peptide
GVIINVKCKISRQCLKPCKEAGMRFGKCMNGKCHCYG

SEQ ID NO: 1089 - protein, 37 aa, Artificial Sequence
  Definition of Artificial Sequence: Synthetic peptide
GVIINVKCKISRQCLKPCKEAGMRFGKCMNGKCACYG

SEQ ID NO: 1090 - protein, 38 aa, Artificial Sequence; identical to SEQ ID NO: 1087
  Definition of Artificial Sequence: Synthetic peptide
  MOD_RES (16)..(16): hLys

SEQ ID NO: 1091 - protein, 38 aa, Artificial Sequence; identical to SEQ ID NO: 1087
  Definition of Artificial Sequence: Synthetic peptide
  MOD_RES (16)..(16): hArg

SEQ ID NO: 1092 - protein, 38 aa, Artificial Sequence; identical to SEQ ID NO: 1087
  Definition of Artificial Sequence: Synthetic peptide
  MOD_RES (16)..(16): Cit

SEQ ID NO: 1093 - protein, 38 aa, Artificial Sequence; identical to SEQ ID NO: 1087
  Definition of Artificial Sequence: Synthetic peptide
  MOD_RES (16)..(16): hCit

SEQ ID NO: 1094 - protein, 38 aa, Artificial Sequence; identical to SEQ ID NO: 1087
  Definition of Artificial Sequence: Synthetic peptide
  MOD_RES (16)..(16): Dpr

SEQ ID NO: 1095 - protein, 38 aa, Artificial Sequence; identical to SEQ ID NO: 1087
  Definition of Artificial Sequence: Synthetic peptide
  MOD_RES (16)..(16): Dab

SEQ ID NO: 1096 - protein, 37 aa, Artificial Sequence; identical to SEQ ID NO: 1089
  Definition of Artificial Sequence: Synthetic peptide

SEQ ID NO: 1097 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCACYGG

SEQ ID NO: 1098 - protein, 38 aa, Artificial Sequence; identical to SEQ ID NO: 1097
  Definition of Artificial Sequence: Synthetic peptide
  MOD_RES (16)..(16): hLys

SEQ ID NO: 1099 - protein, 38 aa, Artificial Sequence; identical to SEQ ID NO: 1097
  Definition of Artificial Sequence: Synthetic peptide
  MOD_RES (16)..(16): hArg

SEQ ID NO: 1100 - protein, 38 aa, Artificial Sequence; identical to SEQ ID NO: 1097
  Definition of Artificial Sequence: Synthetic peptide
  MOD_RES (16)..(16): Cit

SEQ ID NO: 1101 - protein, 38 aa, Artificial Sequence; identical to SEQ ID NO: 1087
  Definition of Artificial Sequence: Synthetic peptide
  MOD_RES (16)..(16): hCit

SEQ ID NO: 1102 - protein, 38 aa, Artificial Sequence; identical to SEQ ID NO: 1097
  Definition of Artificial Sequence: Synthetic peptide
  MOD_RES (16)..(16): Dpr

SEQ ID NO: 1103 - protein, 38 aa, Artificial Sequence; identical to SEQ ID NO: 1097
  Definition of Artificial Sequence: Synthetic peptide
  MOD_RES (16)..(16): Dab

SEQ ID NO: 1104 - protein, 38 aa, Artificial Sequence
  Definition of Artificial Sequence: Synthetic peptide
GVIINVKCKISRQCLKPCKEAGMRFGKCMNGKCACFGG

SEQ ID NO: 1105 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCHCGGG

SEQ ID NO: 1106 - protein, 38 aa, Artificial Sequence; identical to SEQ ID NO: 1105
  Definition of Artificial Sequence: Synthetic peptide
  MOD_RES (16)..(16): hLys

SEQ ID NO: 1107 - protein, 38 aa, Artificial Sequence; identical to SEQ ID NO: 1105
  Definition of Artificial Sequence: Synthetic peptide
  MOD_RES (16)..(16): hArg

SEQ ID NO: 1108 - protein, 38 aa, Artificial Sequence; identical to SEQ ID NO: 1105
  Definition of Artificial Sequence: Synthetic peptide
  MOD_RES (16)..(16): Cit

SEQ ID NO: 1109 - protein, 38 aa, Artificial Sequence; identical to SEQ ID NO: 1105
  Definition of Artificial Sequence: Synthetic peptide
  MOD_RES (16)..(16): hCit

SEQ ID NO: 1110 - protein, 38 aa, Artificial Sequence; identical to SEQ ID NO: 1105
  Definition of Artificial Sequence: Synthetic peptide
  MOD_RES (16)..(16): Dpr

SEQ ID NO: 1111 - protein, 38 aa, Artificial Sequence
  Definition of Artificial Sequence: Synthetic peptide
  MOD_RES (16)..(16): Orn
GVIINVKCKISRQCLXPCKEAGMRFGKCMNGKCACGGG

SEQ ID NO: 1112 - protein, 38 aa, Artificial Sequence; identical to SEQ ID NO: 1111
  Definition of Artificial Sequence: Synthetic peptide
  MOD_RES (16)..(16): hLys

SEQ ID NO: 1113 - protein, 38 aa, Artificial Sequence; identical to SEQ ID NO: 1111
  Definition of Artificial Sequence: Synthetic peptide
  MOD_RES (16)..(16): hArg

SEQ ID NO: 1114 - protein, 38 aa, Artificial Sequence; identical to SEQ ID NO: 1111
  Definition of Artificial Sequence: Synthetic peptide
  MOD_RES (16)..(16): Cit

SEQ ID NO: 1115 - protein, 37 aa, Artificial Sequence
  Definition of Artificial Sequence: Synthetic peptide
  MOD_RES (16)..(16): hCit
GVIINVKCKISRQCLXPCKEAGMRFGKCMNGKCACTP

SEQ ID NO: 1116 - protein, 37 aa, Artificial Sequence; identical to SEQ ID NO: 1115
  Definition of Artificial Sequence: Synthetic peptide
  MOD_RES (16)..(16): Dpr

SEQ ID NO: 1117 - protein, 37 aa, Artificial Sequence; identical to SEQ ID NO: 1115
  Definition of Artificial Sequence: Synthetic peptide
  MOD_RES (16)..(16): Dab

SEQ ID NO: 1118 - protein, 38 aa, Artificial Sequence; identical to SEQ ID NO: 980
  Definition of Artificial Sequence: Synthetic peptide
  MOD_RES (16)..(16): Orn
  c-term amidation

SEQ ID NO: 1119 - protein, 38 aa, Artificial Sequence; identical to SEQ ID NO: 980
  Definition of Artificial Sequence: Synthetic peptide
  MOD_RES (16)..(16): hLys
  c-term amidation

SEQ ID NO: 1120 - protein, 38 aa, Artificial Sequence; identical to SEQ ID NO: 980
  Definition of Artificial Sequence: Synthetic peptide
  MOD_RES (16)..(16): hArg
  c-term amidation

SEQ ID NO: 1121 - protein, 38 aa, Artificial Sequence; identical to SEQ ID NO: 980
  Definition of Artificial Sequence: Synthetic peptide
  MOD_RES (16)..(16): Cit
  c-term amidation

SEQ ID NO: 1122 - protein, 38 aa, Artificial Sequence; identical to SEQ ID NO: 980
  Definition of Artificial Sequence: Synthetic peptide
  MOD_RES (16)..(16): hCit
  c-term amidation

SEQ ID NO: 1123 - protein, 38 aa, Artificial Sequence; identical to SEQ ID NO: 980
  Definition of Artificial Sequence: Synthetic peptide
  MOD_RES (16)..(16): Dpr
  c-term amidation

SEQ ID NO: 1124 - protein, 38 aa, Artificial Sequence; identical to SEQ ID NO: 980
  Definition of Artificial Sequence: Synthetic peptide
  MOD_RES (16)..(16): Dab
  c-term amidation

SEQ ID NO: 1125 - protein, 38 aa, Artificial Sequence; identical to SEQ ID NO: 987
  Definition of Artificial Sequence: Synthetic peptide
  MOD_RES (16)..(16): Orn
  c-term amidation

SEQ ID NO: 1126 - protein, 38 aa, Artificial Sequence; identical to SEQ ID NO: 987
  Definition of Artificial Sequence: Synthetic peptide
  MOD_RES (16)..(16): hLys
  c-term amidation

SEQ ID NO: 1127 - protein, 38 aa, Artificial Sequence; identical to SEQ ID NO: 987
  Definition of Artificial Sequence: Synthetic peptide
  MOD_RES (16)..(16): hArg
  c-term amidation

SEQ ID NO: 1128 - protein, 38 aa, Artificial Sequence; identical to SEQ ID NO: 987
  Definition of Artificial Sequence: Synthetic peptide
  MOD_RES (16)..(16): Cit
  c-term amidation

SEQ ID NO: 1129 - protein, 38 aa, Artificial Sequence; identical to SEQ ID NO: 987
  Definition of Artificial Sequence: Synthetic peptide
  MOD_RES (16)..(16): hCit
  c-term amidation

SEQ ID NO: 1130 - protein, 38 aa, Artificial Sequence; identical to SEQ ID NO: 987
  Definition of Artificial Sequence: Synthetic peptide
  MOD_RES (16)..(16): Dpr
  c-term amidation

SEQ ID NO: 1131 - protein, 38 aa, Artificial Sequence; identical to SEQ ID NO: 987
  Definition of Artificial Sequence: Synthetic peptide
  MOD_RES (16)..(16): Dab
  c-term amidation

SEQ ID NO: 1132 - protein, 38 aa, Artificial Sequence; identical to SEQ ID NO: 999
  Definition of Artificial Sequence: Synthetic peptide
  MOD_RES (16)..(16): Orn
  c-term amidation

SEQ ID NO: 1133 - protein, 38 aa, Artificial Sequence; identical to SEQ ID NO: 999
  Definition of Artificial Sequence: Synthetic peptide
  MOD_RES (16)..(16): hLys
  c-term amidation

SEQ ID NO: 1134 - protein, 38 aa, Artificial Sequence; identical to SEQ ID NO: 999
  Definition of Artificial Sequence: Synthetic peptide
  MOD_RES (16)..(16): hArg
  c-term amidation

SEQ ID NO: 1135 - protein, 38 aa, Artificial Sequence; identical to SEQ ID NO: 999
  Definition of Artificial Sequence: Synthetic peptide
  MOD_RES (16)..(16): Cit
  c-term amidation

SEQ ID NO: 1136 - protein, 38 aa, Artificial Sequence; identical to SEQ ID NO: 999
  Definition of Artificial Sequence: Synthetic peptide
  MOD_RES (16)..(16): hCit
  c-term amidation

SEQ ID NO: 1137 - protein, 38 aa, Artificial Sequence; identical to SEQ ID NO: 999
  Definition of Artificial Sequence: Synthetic peptide
  MOD_RES (16)..(16): Dpr
  c-term amidation

SEQ ID NO: 1138 - protein, 38 aa, Artificial Sequence; identical to SEQ ID NO: 999
  Definition of Artificial Sequence: Synthetic peptide
  MOD_RES (16)..(16): Dab
  c-term amidation

SEQ ID NO: 1139 - protein, 35 aa, Artificial Sequence; identical to SEQ ID NO: 1006
  Definition of Artificial Sequence: Synthetic peptide
  MOD_RES (16)..(16): Orn
  c-term amidation

SEQ ID NO: 1140 - protein, 35 aa, Artificial Sequence; identical to SEQ ID NO: 1006
  Definition of Artificial Sequence: Synthetic peptide
  MOD_RES (16)..(16): hLys
  c-term amidation

SEQ ID NO: 1141 - protein, 35 aa, Artificial Sequence; identical to SEQ ID NO: 1006
  Definition of Artificial Sequence: Synthetic peptide
  MOD_RES (16)..(16): hArg
  c-term amidation

SEQ ID NO: 1142 - protein, 35 aa, Artificial Sequence; identical to SEQ ID NO: 1006
  Definition of Artificial Sequence: Synthetic peptide
  MOD_RES (16)..(16): Cit
  c-term amidation

SEQ ID NO: 1143 - protein, 35 aa, Artificial Sequence; identical to SEQ ID NO: 1006
  Definition of Artificial Sequence: Synthetic peptide
  MOD_RES (16)..(16): hCit
  c-term amidation

SEQ ID NO: 1144 - protein, 35 aa, Artificial Sequence; identical to SEQ ID NO: 1006
  Definition of Artificial Sequence: Synthetic peptide
  MOD_RES (16)..(16): Dpr
  c-term amidation

SEQ ID NO: 1145 - protein, 35 aa, Artificial Sequence; identical to SEQ ID NO: 1013
  Definition of Artificial Sequence: Synthetic peptide
  MOD_RES (16)..(16): Orn
  c-term amidation

SEQ ID NO: 1146 - protein, 35 aa, Artificial Sequence; identical to SEQ ID NO: 1013
  Definition of Artificial Sequence: Synthetic peptide
  MOD_RES (16)..(16): hLys
  c-term amidation

SEQ ID NO: 1147 - protein, 35 aa, Artificial Sequence; identical to SEQ ID NO: 1013
  Definition of Artificial Sequence: Synthetic peptide
  MOD_RES (16)..(16): hArg
  c-term amidation

SEQ ID NO: 1148 - protein, 35 aa, Artificial Sequence; identical to SEQ ID NO: 1013
  Definition of Artificial Sequence: Synthetic peptide
  MOD_RES (16)..(16): Cit
  c-term amidation

SEQ ID NO: 1149 - protein, 35 aa, Artificial Sequence; identical to SEQ ID NO: 1006
  Definition of Artificial Sequence: Synthetic peptide
  MOD_RES (16)..(16): hCit
  c-term amidation

SEQ ID NO: 1150 - protein, 35 aa, Artificial Sequence; identical to SEQ ID NO: 1013
  Definition of Artificial Sequence: Synthetic peptide
  MOD_RES (16)..(16): Dpr
  c-term amidation

SEQ ID NO: 1151 - protein, 35 aa, Artificial Sequence; identical to SEQ ID NO: 1013
  Definition of Artificial Sequence: Synthetic peptide
  MOD_RES (16)..(16): Dab
  c-term amidation

SEQ ID NO: 1152 - protein, 38 aa, Artificial Sequence
  Definition of Artificial Sequence: Synthetic peptide
  c-term amidation
GVIINVKCKISRQCLKPCKDAGMRFGKCMNGKCHCYGG

SEQ ID NO: 1153 - protein, 38 aa, Artificial Sequence; identical to SEQ ID NO: 1021
  Definition of Artificial Sequence: Synthetic peptide
  MOD_RES (16)..(16): Orn
  c-term amidation

SEQ ID NO: 1154 - protein, 38 aa, Artificial Sequence; identical to SEQ ID NO: 1021
  Definition of Artificial Sequence: Synthetic peptide
  MOD_RES (16)..(16): hLys
  c-term amidation

SEQ ID NO: 1155 - protein, 38 aa, Artificial Sequence; identical to SEQ ID NO: 1021
  Definition of Artificial Sequence: Synthetic peptide
  MOD_RES (16)..(16): hArg
  c-term amidation

SEQ ID NO: 1156 - protein, 38 aa, Artificial Sequence; identical to SEQ ID NO: 1021
  Definition of Artificial Sequence: Synthetic peptide
  MOD_RES (16)..(16): Cit
  c-term amidation

SEQ ID NO: 1157 - protein, 38 aa, Artificial Sequence; identical to SEQ ID NO: 1021
  Definition of Artificial Sequence: Synthetic peptide
  MOD_RES (16)..(16): hCit
  c-term amidation

SEQ ID NO: 1158 - protein, 38 aa, Artificial Sequence; identical to SEQ ID NO: 1021
  Definition of Artificial Sequence: Synthetic peptide
  MOD_RES (16)..(16): Dpr
  c-term amidation

SEQ ID NO: 1159 - protein, 38 aa, Artificial Sequence
  Definition of Artificial Sequence: Synthetic peptide
  c-term amidation
GVIINVKCKISRQCLKPCKDAGMRFGKCMNGKCHCFGG

SEQ ID NO: 1160 - protein, 37 aa, Artificial Sequence
  Definition of Artificial Sequence: Synthetic peptide
  c-term amidation
GVIINVKCKISRQCLKPCKDAGMRFGKCMNGKCHCYG

SEQ ID NO: 1161 - protein, 37 aa, Artificial Sequence; identical to SEQ ID NO: 1035
  Definition of Artificial Sequence: Synthetic peptide
  c-term amidation

SEQ ID NO: 1162 - protein, 38 aa, Artificial Sequence; identical to SEQ ID NO: 1028
  Definition of Artificial Sequence: Synthetic peptide
  MOD_RES (16)..(16): Orn
  c-term amidation

SEQ ID NO: 1163 - protein, 38 aa, Artificial Sequence; identical to SEQ ID NO: 1028
  Definition of Artificial Sequence: Synthetic peptide
  MOD_RES (16)..(16): hLys
  c-term amidation

SEQ ID NO: 1164 - protein, 38 aa, Artificial Sequence; identical to SEQ ID NO: 1028
  Definition of Artificial Sequence: Synthetic peptide
  MOD_RES (16)..(16): hArg
  c-term amidation

SEQ ID NO: 1165 - protein, 38 aa, Artificial Sequence; identical to SEQ ID NO: 1028
  Definition of Artificial Sequence: Synthetic peptide
  MOD_RES (16)..(16): Cit
  c-term amidation

SEQ ID NO: 1166 - protein, 38 aa, Artificial Sequence; identical to SEQ ID NO: 1028
  Definition of Artificial Sequence: Synthetic peptide
  MOD_RES (16)..(16): hCit
  c-term amidation

SEQ ID NO: 1167 - protein, 38 aa, Artificial Sequence; identical to SEQ ID NO: 1028
  Definition of Artificial Sequence: Synthetic peptide
  MOD_RES (16)..(16): Dpr
  c-term amidation

SEQ ID NO: 1168 - protein, 38 aa, Artificial Sequence; identical to SEQ ID NO: 1028
  Definition of Artificial Sequence: Synthetic peptide
  MOD_RES (16)..(16): Dab
  c-term amidation

SEQ ID NO: 1169 - protein, 38 aa, Artificial Sequence; identical to SEQ ID NO: 1027
  Definition of Artificial Sequence: Synthetic peptide
  c-term amidation

SEQ ID NO: 1170 - protein, 38 aa, Artificial Sequence; identical to SEQ ID NO: 1036
  Definition of Artificial Sequence: Synthetic peptide
  MOD_RES (16)..(16): Orn
  c-term amidation

SEQ ID NO: 1171 - protein, 38 aa, Artificial Sequence; identical to SEQ ID NO: 1036
  Definition of Artificial Sequence: Synthetic peptide
  MOD_RES (16)..(16): hLys
  c-term amidation

SEQ ID NO: 1172 - protein, 38 aa, Artificial Sequence; identical to SEQ ID NO: 1036
  Definition of Artificial Sequence: Synthetic peptide
  MOD_RES (16)..(16): hArg
  c-term amidation

SEQ ID NO: 1173 - protein, 38 aa, Artificial Sequence; identical to SEQ ID NO: 1036
  Definition of Artificial Sequence: Synthetic peptide
  MOD_RES (16)..(16): Cit
  c-term amidation

SEQ ID NO: 1174 - protein, 38 aa, Artificial Sequence; identical to SEQ ID NO: 1036
  Definition of Artificial Sequence: Synthetic peptide
  MOD_RES (16)..(16): hCit
  c-term amidation

SEQ ID NO: 1175 - protein, 38 aa, Artificial Sequence; identical to SEQ ID NO: 1036
  Definition of Artificial Sequence: Synthetic peptide
  MOD_RES (16)..(16): Dpr
  c-term amidation

SEQ ID NO: 1176 - protein, 38 aa, Artificial Sequence
  Definition of Artificial Sequence: Synthetic peptide
  c-term amidation
GVIINVKCKISRQCLKPCKDAGMRFGKCMNGKCACGGG

SEQ ID NO: 1177 - protein, 38 aa, Artificial Sequence
  Definition of Artificial Sequence: Synthetic peptide
  MOD_RES (16)..(16): Orn
  c-term amidation
GVIINVKCKISRQCLXPCKDAGMRFGKCMNGKCACFGG

SEQ ID NO: 1178 - protein, 38 aa, Artificial Sequence; identical to SEQ ID NO: 1043
  Definition of Artificial Sequence: Synthetic peptide
  MOD_RES (16)..(16): Orn
  c-term amidation

SEQ ID NO: 1179 - protein, 38 aa, Artificial Sequence; identical to SEQ ID NO: 1043
  Definition of Artificial Sequence: Synthetic peptide
  MOD_RES (16)..(16): hLys
  c-term amidation

SEQ ID NO: 1180 - protein, 38 aa, Artificial Sequence; identical to SEQ ID NO: 1043
  Definition of Artificial Sequence: Synthetic peptide
  MOD_RES (16)..(16): hArg
  c-term amidation

SEQ ID NO: 1181 - protein, 38 aa, Artificial Sequence; identical to SEQ ID NO: 1043
  Definition of Artificial Sequence: Synthetic peptide
  MOD_RES (16)..(16): Cit
  c-term amidation

SEQ ID NO: 1182 - protein, 38 aa, Artificial Sequence; identical to SEQ ID NO: 1043
  Definition of Artificial Sequence: Synthetic peptide
  MOD_RES (16)..(16): hCit
  c-term amidation

SEQ ID NO: 1183 - protein, 38 aa, Artificial Sequence; identical to SEQ ID NO: 1043
  Definition of Artificial Sequence: Synthetic peptide
  MOD_RES (16)..(16): Dpr
  c-term amidation

SEQ ID NO: 1184 - protein, 38 aa, Artificial Sequence; identical to SEQ ID NO: 1043
  Definition of Artificial Sequence: Synthetic peptide
  MOD_RES (16)..(16): Dab
  c-term amidation

SEQ ID NO: 1185 - protein, 38 aa, Artificial Sequence; identical to SEQ ID NO: 1053
  Definition of Artificial Sequence: Synthetic peptide
  MOD_RES (16)..(16): Orn
  c-term amidation

SEQ ID NO: 1186 - protein, 38 aa, Artificial Sequence; identical to SEQ ID NO: 1053
  Definition of Artificial Sequence: Synthetic peptide
  MOD_RES (16)..(16): hLys
  c-term amidation

SEQ ID NO: 1187 - protein, 38 aa, Artificial Sequence; identical to SEQ ID NO: 1053
  Definition of Artificial Sequence: Synthetic peptide
  MOD_RES (16)..(16): hArg
  c-term amidation

SEQ ID NO: 1188 - protein, 38 aa, Artificial Sequence; identical to SEQ ID NO: 1053
  Definition of Artificial Sequence: Synthetic peptide
  MOD_RES (16)..(16): Cit
  c-term amidation

SEQ ID NO: 1189 - protein, 38 aa, Artificial Sequence; identical to SEQ ID NO: 1053
  Definition of Artificial Sequence: Synthetic peptide
  MOD_RES (16)..(16): hCit
  c-term amidation

SEQ ID NO: 1190 - protein, 38 aa, Artificial Sequence; identical to SEQ ID NO: 1053
  Definition of Artificial Sequence: Synthetic peptide
  MOD_RES (16)..(16): Dpr
  c-term amidation

SEQ ID NO: 1191 - protein, 38 aa, Artificial Sequence; identical to SEQ ID NO: 1053
  Definition of Artificial Sequence: Synthetic peptide
  MOD_RES (16)..(16): Dab
  c-term amidation

SEQ ID NO: 1192 - protein, 38 aa, Artificial Sequence; identical to SEQ ID NO: 1059
  Definition of Artificial Sequence: Synthetic peptide
  MOD_RES (16)..(16): Orn
  c-term amidation

SEQ ID NO: 1193 - protein, 38 aa, Artificial Sequence; identical to SEQ ID NO: 1059
  Definition of Artificial Sequence: Synthetic peptide
  MOD_RES (16)..(16): hLys
  c-term amidation

SEQ ID NO: 1194 - protein, 38 aa, Artificial Sequence; identical to SEQ ID NO: 1059
  Definition of Artificial Sequence: Synthetic peptide
  MOD_RES (16)..(16): hArg
  c-term amidation

SEQ ID NO: 1195 - protein, 38 aa, Artificial Sequence; identical to SEQ ID NO: 1059
  Definition of Artificial Sequence: Synthetic peptide
  MOD_RES (16)..(16): Cit
  c-term amidation

SEQ ID NO: 1196 - protein, 38 aa, Artificial Sequence; identical to SEQ ID NO: 1059
  Definition of Artificial Sequence: Synthetic peptide
  MOD_RES (16)..(16): hCit
  c-term amidation

SEQ ID NO: 1197 - protein, 38 aa, Artificial Sequence; identical to SEQ ID NO: 1059
  Definition of Artificial Sequence: Synthetic peptide
  MOD_RES (16)..(16): Dpr
  c-term amidation

SEQ ID NO: 1198 - protein, 38 aa, Artificial Sequence; identical to SEQ ID NO: 1059
  Definition of Artificial Sequence: Synthetic peptide
  MOD_RES (16)..(16): Dab
  c-term amidation

SEQ ID NO: 1199 - protein, 38 aa, Artificial Sequence; identical to SEQ ID NO: 1066
  Definition of Artificial Sequence: Synthetic peptide
  MOD_RES (16)..(16): Orn
  c-term amidation

SEQ ID NO: 1200 - protein, 38 aa, Artificial Sequence; identical to SEQ ID NO: 1066
  Definition of Artificial Sequence: Synthetic peptide
  MOD_RES (16)..(16): hLys
  c-term amidation

SEQ ID NO: 1201 - protein, 38 aa, Artificial Sequence; identical to SEQ ID NO: 1066
  Definition of Artificial Sequence: Synthetic peptide
  MOD_RES (16)..(16): hArg
  c-term amidation

SEQ ID NO: 1202 - protein, 38 aa, Artificial Sequence; identical to SEQ ID NO: 1066
  Definition of Artificial Sequence: Synthetic peptide
  MOD_RES (16)..(16): Cit
  c-term amidation

SEQ ID NO: 1203 - protein, 38 aa, Artificial Sequence; identical to SEQ ID NO: 1066
  Definition of Artificial Sequence: Synthetic peptide
  MOD_RES (16)..(16): hCit
  c-term amidation

SEQ ID NO: 1204 - protein, 38 aa, Artificial Sequence; identical to SEQ ID NO: 1066
  Definition of Artificial Sequence: Synthetic peptide
  MOD_RES (16)..(16): Dpr
  c-term amidation

SEQ ID NO: 1205 - protein, 38 aa, Artificial Sequence; identical to SEQ ID NO: 1066
  Definition of Artificial Sequence: Synthetic peptide
  MOD_RES (16)..(16): Dab
  c-term amidation

SEQ ID NO: 1206 - protein, 35 aa, Artificial Sequence; identical to SEQ ID NO: 1073
  Definition of Artificial Sequence: Synthetic peptide
  MOD_RES (16)..(16): Orn
  c-term amidation

SEQ ID NO: 1207 - protein, 35 aa, Artificial Sequence; identical to SEQ ID NO: 1073
  Definition of Artificial Sequence: Synthetic peptide
  MOD_RES (16)..(16): hLys
  c-term amidation

SEQ ID NO: 1208 - protein, 35 aa, Artificial Sequence; identical to SEQ ID NO: 1073
  Definition of Artificial Sequence: Synthetic peptide
  MOD_RES (16)..(16): hArg
  c-term amidation

SEQ ID NO: 1209 - protein, 35 aa, Artificial Sequence; identical to SEQ ID NO: 1073
  Definition of Artificial Sequence: Synthetic peptide
  MOD_RES (16)..(16): Cit
  c-term amidation

SEQ ID NO: 1210 - protein, 35 aa, Artificial Sequence; identical to SEQ ID NO: 1073
  Definition of Artificial Sequence: Synthetic peptide
  MOD_RES (16)..(16): hCit
  c-term amidation

SEQ ID NO: 1211 - protein, 35 aa, Artificial Sequence; identical to SEQ ID NO: 1073
  Definition of Artificial Sequence: Synthetic peptide
  MOD_RES (16)..(16): Dpr
  c-term amidation

SEQ ID NO: 1212 - protein, 35 aa, Artificial Sequence; identical to SEQ ID NO: 1079
  Definition of Artificial Sequence: Synthetic peptide
  MOD_RES (16)..(16): Orn
  c-term amidation

SEQ ID NO: 1213 - protein, 35 aa, Artificial Sequence; identical to SEQ ID NO: 1079
  Definition of Artificial Sequence: Synthetic peptide
  MOD_RES (16)..(16): hLys
  c-term amidation

SEQ ID NO: 1214 - protein, 35 aa, Artificial Sequence; identical to SEQ ID NO: 1079
  Definition of Artificial Sequence: Synthetic peptide
  MOD_RES (16)..(16): hArg
  c-term amidation

SEQ ID NO: 1215 - protein, 35 aa, Artificial Sequence; identical to SEQ ID NO: 1079
  Definition of Artificial Sequence: Synthetic peptide
  MOD_RES (16)..(16): Cit
  c-term amidation

SEQ ID NO: 1216 - protein, 35 aa, Artificial Sequence; identical to SEQ ID NO: 1073
  Definition of Artificial Sequence: Synthetic peptide
  MOD_RES (16)..(16): hCit
  c-term amidation

SEQ ID NO: 1217 - protein, 35 aa, Artificial Sequence; identical to SEQ ID NO: 1079
  Definition of Artificial Sequence: Synthetic peptide
  MOD_RES (16)..(16): Dpr
  c-term amidation

SEQ ID NO: 1218 - protein, 35 aa, Artificial Sequence; identical to SEQ ID NO: 1079
  Definition of Artificial Sequence: Synthetic peptide
  MOD_RES (16)..(16): Dab
  c-term amidation

SEQ ID NO: 1219 - protein, 38 aa, Artificial Sequence
  Definition of Artificial Sequence: Synthetic peptide
  c-term amidation
GVIINVKCKISRQCLKPCKEAGMRFGKCMNGKCHCWGG

SEQ ID NO: 1220 - protein, 38 aa, Artificial Sequence; identical to SEQ ID NO: 1087
  Definition of Artificial Sequence: Synthetic peptide
  MOD_RES (16)..(16): Orn
  c-term amidation

SEQ ID NO: 1221 - protein, 38 aa, Artificial Sequence; identical to SEQ ID NO: 1087
  Definition of Artificial Sequence: Synthetic peptide
  MOD_RES (16)..(16): hLys
  c-term amidation

SEQ ID NO: 1222 - protein, 38 aa, Artificial Sequence; identical to SEQ ID NO: 1087
  Definition of Artificial Sequence: Synthetic peptide
  MOD_RES (16)..(16): hArg
  c-term amidation

SEQ ID NO: 1223 - protein, 38 aa, Artificial Sequence; identical to SEQ ID NO: 1087
  Definition of Artificial Sequence: Synthetic peptide
  MOD_RES (16)..(16): Cit
  c-term amidation

SEQ ID NO: 1224 - protein, 38 aa, Artificial Sequence; identical to SEQ ID NO: 1087
  Definition of Artificial Sequence: Synthetic peptide
  MOD_RES (16)..(16): hCit
  c-term amidation

SEQ ID NO: 1225 - protein, 38 aa, Artificial Sequence; identical to SEQ ID NO: 1087
  Definition of Artificial Sequence: Synthetic peptide
  MOD_RES (16)..(16): Dpr
  c-term amidation

SEQ ID NO: 1226 - protein, 38 aa, Artificial Sequence; identical to SEQ ID NO: 1087
  Definition of Artificial Sequence: Synthetic peptide
  MOD_RES (16)..(16): Dab
  c-term amidation

SEQ ID NO: 1227 - protein, 38 aa, Artificial Sequence
  Definition of Artificial Sequence: Synthetic peptide
  c-term amidation
GVIINVKCKISRQCLKPCKEAGMRFGKCMNGKCACYGG

SEQ ID NO: 1228 - protein, 38 aa, Artificial Sequence; identical to SEQ ID NO: 1097
  Definition of Artificial Sequence: Synthetic peptide
  MOD_RES (16)..(16): Orn
  c-term amidation

SEQ ID NO: 1229 - protein, 38 aa, Artificial Sequence; identical to SEQ ID NO: 1097
  Definition of Artificial Sequence: Synthetic peptide
  MOD_RES (16)..(16): hLys
  c-term amidation

SEQ ID NO: 1230 - protein, 38 aa, Artificial Sequence; identical to SEQ ID NO: 1097
  Definition of Artificial Sequence: Synthetic peptide
  MOD_RES (16)..(16): hArg
  c-term amidation

SEQ ID NO: 1231 - protein, 38 aa, Artificial Sequence; identical to SEQ ID NO: 1097
  Definition of Artificial Sequence: Synthetic peptide
  MOD_RES (16)..(16): Cit
  c-term amidation

SEQ ID NO: 1232 - protein, 38 aa, Artificial Sequence; identical to SEQ ID NO: 1087
  Definition of Artificial Sequence: Synthetic peptide
  MOD_RES (16)..(16): hCit
  c-term amidation

SEQ ID NO: 1233 - protein, 38 aa, Artificial Sequence; identical to SEQ ID NO: 1097
  Definition of Artificial Sequence: Synthetic peptide
  MOD_RES (16)..(16): Dpr
  c-term amidation

SEQ ID NO: 1234 - protein, 38 aa, Artificial Sequence; identical to SEQ ID NO: 1097
  Definition of Artificial Sequence: Synthetic peptide
  MOD_RES (16)..(16): Dab
  c-term amidation

SEQ ID NO: 1235 - protein, 38 aa, Artificial Sequence; identical to SEQ ID NO: 1105
  Definition of Artificial Sequence: Synthetic peptide
  MOD_RES (16)..(16): Orn
  c-term amidation

SEQ ID NO: 1236 - protein, 38 aa, Artificial Sequence; identical to SEQ ID NO: 1105
  Definition of Artificial Sequence: Synthetic peptide
  MOD_RES (16)..(16): hLys
  c-term amidation

SEQ ID NO: 1237 - protein, 38 aa, Artificial Sequence; identical to SEQ ID NO: 1105
  Definition of Artificial Sequence: Synthetic peptide
  MOD_RES (16)..(16): hArg
  c-term amidation

SEQ ID NO: 1238 - protein, 38 aa, Artificial Sequence; identical to SEQ ID NO: 1105
  Definition of Artificial Sequence: Synthetic peptide
  MOD_RES (16)..(16): Cit
  c-term amidation

SEQ ID NO: 1239 - protein, 38 aa, Artificial Sequence; identical to SEQ ID NO: 1105
  Definition of Artificial Sequence: Synthetic peptide
  MOD_RES (16)..(16): hCit
  c-term amidation

SEQ ID NO: 1240 - protein, 38 aa, Artificial Sequence; identical to SEQ ID NO: 1105
  Definition of Artificial Sequence: Synthetic peptide
  MOD_RES (16)..(16): Dpr
  c-term amidation

SEQ ID NO: 1241 - protein, 38 aa, Artificial Sequence; identical to SEQ ID NO: 1111
  Definition of Artificial Sequence: Synthetic peptide
  MOD_RES (16)..(16): Orn
  c-term amidation

SEQ ID NO: 1242 - protein, 38 aa, Artificial Sequence; identical to SEQ ID NO: 1111
  Definition of Artificial Sequence: Synthetic peptide
  MOD_RES (16)..(16): hLys
  c-term amidation

SEQ ID NO: 1243 - protein, 38 aa, Artificial Sequence; identical to SEQ ID NO: 1111
  Definition of Artificial Sequence: Synthetic peptide
  MOD_RES (16)..(16): hArg
  c-term amidation

SEQ ID NO: 1244 - protein, 38 aa, Artificial Sequence; identical to SEQ ID NO: 1111
  Definition of Artificial Sequence: Synthetic peptide
  MOD_RES (16)..(16): Cit
  c-term amidation

SEQ ID NO: 1245 - protein, 37 aa, Artificial Sequence; identical to SEQ ID NO: 1115
  Definition of Artificial Sequence: Synthetic peptide
  MOD_RES (16)..(16): hCit
  c-term amidation

SEQ ID NO: 1246 - protein, 38 aa, Artificial Sequence; identical to SEQ ID NO: 1111
  Definition of Artificial Sequence: Synthetic peptide
  MOD_RES (16)..(16): Dpr
  c-term amidation

SEQ ID NO: 1247 - protein, 38 aa, Artificial Sequence; identical to SEQ ID NO: 1111
  Definition of Artificial Sequence: Synthetic peptide
  MOD_RES (16)..(16): Dab
  c-term amidation

SEQ ID NO: 1248 - protein, 38 aa, Artificial Sequence
  Definition of Artificial Sequence: Synthetic peptide
  MOD_RES (20)..(20): Cpa
  c-term amidation
GVIINVKCKISRQCLKPCKXAGMRFGKCMNGKCACYGG

SEQ ID NO: 1249 - protein, 38 aa, Artificial Sequence
  Definition of Artificial Sequence: Synthetic peptide
  MOD_RES (20)..(20): Cpa
  c-term amidation
GVIINVKCKISRQCLKPCKXAGMRFGKCMNGKCACGGG

SEQ ID NO: 1250 - protein, 36 aa, Artificial Sequence
  Definition of Artificial Sequence: Synthetic peptide
  MOD_RES (20)..(20): Cpa
  c-term amidation
GVIINVKCKISRQCLKPCKXAGMRFGKCMNGKCACY

SEQ ID NO: 1251 - protein, 38 aa, Artificial Sequence; identical to SEQ ID NO: 1027
  Definition of Artificial Sequence: Synthetic peptide
  n-term acetylation
  c-term amidation

SEQ ID NO: 1252 - protein, 38 aa, Artificial Sequence; identical to SEQ ID NO: 1248
  Definition of Artificial Sequence: Synthetic peptide
  MOD_RES (20)..(20): Aad
  c-term amidation

SEQ ID NO: 1253 - protein, 38 aa, Artificial Sequence
  Definition of Artificial Sequence: Synthetic peptide
  MOD_RES (20)..(20): Aad
  c-term amidation
GVIINVKCKISRQCLKPCKXAGMRFGKCMNGKCHCYGG

SEQ ID NO: 1254 - protein, 38 aa, Artificial Sequence; identical to SEQ ID NO: 1248
  Definition of Artificial Sequence: Synthetic peptide
  MOD_RES (20)..(20): Aad

SEQ ID NO: 1255 - protein, 38 aa, Artificial Sequence
  Definition of Artificial Sequence: Synthetic peptide
  c-term amidation
GVIINVKCKISRQCLHPCKDAGMRFGKCMNGKCACYGG

SEQ ID NO: 1256 - protein, 38 aa, Artificial Sequence; identical to SEQ ID NO: 1255
  Definition of Artificial Sequence: Synthetic peptide

SEQ ID NO: 1257 - protein, 36 aa, Artificial Sequence
  Definition of Artificial Sequence: Synthetic peptide
  c-term amidation
GVIINVKCKISRQCLHPCKDAGMRFGKCMNGKCACY

SEQ ID NO: 1258 - protein, 38 aa, Artificial Sequence
  Definition of Artificial Sequence: Synthetic peptide
  c-term amidation
GVIINVKCKISRQCLHPCKDAGMRFGKCMNGKCHCYGG

SEQ ID NO: 1259 - protein, 38 aa, Artificial Sequence; identical to SEQ ID NO: 1258
  Definition of Artificial Sequence: Synthetic peptide

SEQ ID NO: 1260 - protein, 38 aa, Artificial Sequence
  Definition of Artificial Sequence: Synthetic peptide
GVIINVKCKISRQCLHPCKDAGMRFGKCMNGKCHCYPK

SEQ ID NO: 1261 - protein, 35 aa, Artificial Sequence
  Definition of Artificial Sequence: Synthetic peptide
GVIINVKCKISRQCLHPCKDAGMRFGKCMNGKCAC

SEQ ID NO: 1262 - protein, 38 aa, Artificial Sequence
  Definition of Artificial Sequence: Synthetic peptide
  MOD_RES (36)..(36): 1Nal
  c-term amidation
GVIINVKCKISRQCLKPCKDAGMRFGKCMNGKCACXGG

SEQ ID NO: 1263 - protein, 38 aa, Artificial Sequence
  Definition of Artificial Sequence: Synthetic peptide
  MOD_RES (36)..(36): 1Nal
  c-term amidation
GVIINVKCKISRQCLKPCKDAGMRFGKCMNGKCACXPK

SEQ ID NO: 1264 - protein, 38 aa, Artificial Sequence; identical to SEQ ID NO: 1262
  Definition of Artificial Sequence: Synthetic peptide
  MOD_RES (36)..(36): 2Nal
  c-term amidation

SEQ ID NO: 1265 - protein, 38 aa, Artificial Sequence; identical to SEQ ID NO: 1262
  Definition of Artificial Sequence: Synthetic peptide
  MOD_RES (36)..(36): Cha
  c-term amidation

SEQ ID NO: 1266 - protein, 38 aa, Artificial Sequence; identical to SEQ ID NO: 1262
  Definition of Artificial Sequence: Synthetic peptide
  MOD_RES (36)..(36): MePhe
  c-term amidation

SEQ ID NO: 1267 - protein, 38 aa, Artificial Sequence; identical to SEQ ID NO: 1262
  Definition of Artificial Sequence: Synthetic peptide
  MOD_RES (36)..(36): BiPhA
  c-term amidation

SEQ ID NO: 1268 - protein, 38 aa, Artificial Sequence
  Definition of Artificial Sequence: Synthetic peptide
  MOD_RES (34)..(34): Aib
  c-term amidation
GVIINVKCKISRQCLKPCKDAGMRFGKCMNGKCXCYGG

SEQ ID NO: 1269 - protein, 38 aa, Artificial Sequence; identical to SEQ ID NO: 1268
  Definition of Artificial Sequence: Synthetic peptide
  MOD_RES (34)..(34): Abu
  c-term amidation

SEQ ID NO: 1270 - protein, 36 aa, Artificial Sequence
  Definition of Artificial Sequence: Synthetic peptide
  MOD_RES (36)..(36): 1Nal
GVIINVKCKISRQCLKPCKDAGMRFGKCMNGKCACX

SEQ ID NO: 1271 - protein, 38 aa, Artificial Sequence
  Definition of Artificial Sequence: Synthetic peptide
  MOD_RES (36)..(36): 1Nal
  c-term amidation
GVIINVKCKISRQCLHPCKDAGMRFGKCMNGKCACXGG

SEQ ID NO: 1272 - protein, 36 aa, Artificial Sequence; identical to SEQ ID NO: 1270
  Definition of Artificial Sequence: Synthetic peptide
  MOD_RES (36)..(36): 4Bip
  c-term amidation

SEQ ID NO: 1273 - protein, 38 aa, Artificial Sequence; identical to SEQ ID NO: 1271
  Definition of Artificial Sequence: Synthetic peptide
  MOD_RES (36)..(36): 4Bip
  c-term amidation

SEQ ID NO: 1274 - protein, 38 aa, Artificial Sequence
  Definition of Artificial Sequence: Synthetic peptide
GVIINVKCKISRQCLKPCKDAGMRFGKCMNGKCHCGGG

SEQ ID NO: 1275 - protein, 38 aa, Artificial Sequence
  Definition of Artificial Sequence: Synthetic peptide
ADCVGDGQRCADWAGPYCCSGYYCSCRSMPYCRCRSDS

SEQ ID NO: 1276 - protein, 63 aa, Parabuthus transvaalicus
KIDGYPVDYWNCKRICWYNNKYCNDLCKGLKADSGYCWGWTLSCYCQGLPDNARIKRSGRCRA

SEQ ID NO: 1277 - protein, 77 aa, Artificial Sequence
  Definition of Artificial Sequence: Synthetic peptide
AELTSCFPVGHECDGDASNCNCCGDDVYCGCGWGRWNCKCKVADQSYAYGICKDKVNCPNRHLWPAKVCKKPCRREC

SEQ ID NO: 1278 - protein, 34 aa, Artificial Sequence
  Definition of Artificial Sequence: Synthetic peptide
  MOD_RES (31)..(31): variable amino acid
GCANAYKSCNGPHTCCWGYNGYKKACICSGXNWK

SEQ ID NO: 1279 - protein, 40 aa, Artificial Sequence
  Definition of Artificial Sequence: Synthetic peptide
SCINVGDFCDGKKDCCQCDRDNAFCSCSVIFGYKTNCRCE

SEQ ID NO: 1280 - protein, 76 aa, Artificial Sequence
  Definition of Artificial Sequence: Synthetic peptide
SCINVGDFCDGKKDDCQCCRDNAFCSCSVIFGYKTNCRCEVGTTATSYGICMAKHKCGRQTTCTKPCLSKRCKKNH

SEQ ID NO: 1281 - protein, 74 aa, Artificial Sequence
  Definition of Artificial Sequence: Synthetic peptide
AECLMIGDTSCVPRLGRRCCYGAWCYCDQQLSCRRVGRKRECGWVEVNCKCGWSWSQRIDDWRADYSCKCPEDQ

SEQ ID NO: 1282 - protein, 35 aa, Artificial Sequence
  Definition of Artificial Sequence: Synthetic peptide
GGCLPHNRFCNALSGPRCCSGLKCKELSIWDSRCL

SEQ ID NO: 1283 - protein, 36 aa, Artificial Sequence
  Definition of Artificial Sequence: Synthetic peptide
DCVRFWGKCSQTSDCCPHLACKSKWPRNICVWDGSV

SEQ ID NO: 1284 - protein, 31 aa, Conus pennaceus
GCLEVDYFCGIPFANNGLCCSGNCVFVCTPQ

SEQ ID NO: 1285 - protein, 30 aa, Conus pennaceus
DDDCEPPGNFCGMIKIGPPCCSGWCFFACA

SEQ ID NO: 1286 - protein, 11 aa, Conus marmoreus
VCCGYKLCHPC

SEQ ID NO: 1287 - protein, 61 aa, Conus marmoreus
MRCLPVLIILLLLTASAPGVVVLPKTEDDVPMSSVYGNGKSILRGILRNGVCCGYKLCHPC

SEQ ID NO: 1288 - protein, 77 aa, Phoneutria nigriventer; identical to SEQ ID NO: 1277

SEQ ID NO: 1289 - protein, 34 aa, Phoneutria nigriventer; identical to SEQ ID NO: 1278
  MOD_RES (31)..(31): variable amino acid

SEQ ID NO: 1290 - protein, 40 aa, Phoneutria nigriventer; identical to SEQ ID NO: 1279

SEQ ID NO: 1291 - protein, 76 aa, Phoneutria nigriventer; identical to SEQ ID NO: 1280

SEQ ID NO: 1292 - protein, 74 aa, Filistata hibernalis; identical to SEQ ID NO: 1281

SEQ ID NO: 1293 - protein, 35 aa, Agelena opulenta; identical to SEQ ID NO: 1282

SEQ ID NO: 1294 - protein, 36 aa, Grammostola spatulata; identical to SEQ ID NO: 1283

SEQ ID NO: 1295 - protein, 35 aa, Artificial Sequence
  Definition of Artificial Sequence: Synthetic peptide
QSCADTIPKSRCTAAQCKHSMKYRLSFCRKTCGTC

SEQ ID NO: 1296 - protein, 35 aa, Artificial Sequence
  Definition of Artificial Sequence: Synthetic peptide
QSCADTIPKSRCTAAQCKHSMAYRLSFCRKTCGTC

SEQ ID NO: 1297 - protein, 35 aa, Artificial Sequence
  Definition of Artificial Sequence: Synthetic peptide
  MOD_RES (22)..(22): Diaminopropionic acid
QSCADTIPKSRCTAAQCKHSMXYRLSFCRKTCGTC

SEQ ID NO: 1298 - protein, 35 aa, Artificial Sequence
  Definition of Artificial Sequence: Synthetic peptide
QSCADTIPKSRCTAAQCKHSMKYRASFCRKTCGTC

SEQ ID NO: 1299 - protein, 35 aa, Artificial Sequence
  Definition of Artificial Sequence: Synthetic peptide
QSCADTIPKSRCTAAQCKHSMAYRASFCRKTCGTC

SEQ ID NO: 1300 - protein, 35 aa, Artificial Sequence
  Definition of Artificial Sequence: Synthetic peptide
  MOD_RES (22)..(22): Diaminopropionic acid
QSCADTIPKSRCTAAQCKHSMXYRASFCRKTCGTC

SEQ ID NO: 1301 - protein, 34 aa, Artificial Sequence
  Definition of Artificial Sequence: Synthetic peptide
VSCRGSKDCYAPCRKQTGCPNAKCINKSCKCYGC

SEQ ID NO: 1302 - protein, 34 aa, Artificial Sequence
  Definition of Artificial Sequence: Synthetic peptide
VSCGGSKDCYAPCRKQTGCPNAKCINKSCKCYGC

SEQ ID NO: 1303 - protein, 38 aa, Artificial Sequence
  Definition of Artificial Sequence: Synthetic peptide
GVIINVSCKISRQCLEPCKKAGMRFGKCMNGKCHCTPK

SEQ ID NO: 1304 - protein, 34 aa, Artificial Sequence
  Definition of Artificial Sequence: Synthetic peptide
VSCTTSKDCYAPCRKQTGCPNAKCINKSCKCYGC

SEQ ID NO: 1305 - protein, 34 aa, Artificial Sequence
  Definition of Artificial Sequence: Synthetic peptide
VSCTASKDCYAPCRKQTGCPNAKCINKSCKCYGC

SEQ ID NO: 1306 - protein, 34 aa, Artificial Sequence
  Definition of Artificial Sequence: Synthetic peptide
VSCTGTKDCYAPCRKQTGCPNAKCINKSCKCYGC

SEQ ID NO: 1307 - protein, 34 aa, Artificial Sequence
  Definition of Artificial Sequence: Synthetic peptide
VSCTGPKDCYAPCRKQTGCPNAKCINKSCKCYGC

SEQ ID NO: 1308 - protein, 38 aa, Artificial Sequence
  Definition of Artificial Sequence: Synthetic peptide
GVIINVSCKISRQCLKPCKDAGMRFGKCMNGKCHCTPK

SEQ ID NO: 1309 - protein, 34 aa, Artificial Sequence
  Definition of Artificial Sequence: Synthetic peptide
VSCTGSKDCGAPCRKQTGCPNAKCINKSCKCYGC

SEQ ID NO: 1310 - DNA, 63 bp, Artificial Sequence
  Definition of Artificial Sequence: Synthetic peptide
accagcttttttgcacggttccaggcactgacgggagattttgcatttaacgttgatgataac

SEQ ID NO: 1311 - protein, 34 aa, Artificial Sequence
  Definition of Artificial Sequence: Synthetic peptide
VSCTGSKDCYRPCRKQTGCPNAKCINKSCKCYGC

SEQ ID NO: 1312 - protein, 34 aa, Artificial Sequence
  Definition of Artificial Sequence: Synthetic peptide
VSCTGSKDCYDPCRKQTGCPNAKCINKSCKCYGC

SEQ ID NO: 1313 - DNA, 83 bp, Artificial Sequence
  Definition of Artificial Sequence: Synthetic peptide
gggtcgttcttgtattgatactattccaaaatctcgttgtactgcttttcaatgtaaacattctatgaaatatcgtctttctt

SEQ ID NO: 1314 - DNA, 44 bp, Artificial Sequence; identical to SEQ ID NO: 762
  Definition of Artificial Sequence: Synthetic peptide

SEQ ID NO: 1315 - protein, 34 aa, Artificial Sequence
  Definition of Artificial Sequence: Synthetic peptide
VSCTGSKDCYAPCRKRTGCPNAKCINKSCKCYGC

SEQ ID NO: 1316 - protein, 34 aa, Artificial Sequence
  Definition of Artificial Sequence: Synthetic peptide
VSCTGSKDCYAPCRKETGCPNAKCINKSCKCYGC

SEQ ID NO: 1317 - protein, 34 aa, Artificial Sequence
  Definition of Artificial Sequence: Synthetic peptide
VSCTGSKDCYAPCRKQTGCPYAKCINKSCKCYGC

SEQ ID NO: 1318 - protein, 34 aa, Artificial Sequence
  Definition of Artificial Sequence: Synthetic peptide
VSCTGSKDCYAPCRKQTGCPNSKCINKSCKCYGC

SEQ ID NO: 1319 - protein, 34 aa, Artificial Sequence
  Definition of Artificial Sequence: Synthetic peptide
VSCTGSKDCYAPCRKQTGCPNGKCINKSCKCYGC

SEQ ID NO: 1320 - protein, 34 aa, Artificial Sequence
  Definition of Artificial Sequence: Synthetic peptide
VSCTGSKDCYAPCRKQTGCPNAKCINRSCKCYGC

SEQ ID NO: 1321 - protein, 34 aa, Artificial Sequence
  Definition of Artificial Sequence: Synthetic peptide
VSCTGSKDCYAPCRKQTGCPNAKCINKTCKCYGC

SEQ ID NO: 1322 - protein, 34 aa, Artificial Sequence
  Definition of Artificial Sequence: Synthetic peptide
VSCTGSKDCYAPCRKQTGCPNAKCINKMCKCYGC

SEQ ID NO: 1323 - protein, 34 aa, Artificial Sequence
  Definition of Artificial Sequence: Synthetic peptide
VSCTGSKDCYAPCRKQTGCPNAKCINKKCKCYGC

SEQ ID NO: 1324 - protein, 34 aa, Artificial Sequence
  Definition of Artificial Sequence: Synthetic peptide
VSCTGSKDCYAPCRKQTGCPNAKCINKSCKCNGC

SEQ ID NO: 1325 - protein, 34 aa, Artificial Sequence
  Definition of Artificial Sequence: Synthetic peptide
VSCTGSKDCYAPCRKQTGCPNAKCINKSCKCYRC

SEQ ID NO: 1326 - protein, 35 aa, Artificial Sequence
  Definition of Artificial Sequence: Synthetic peptide
VSCTGSKDCYAPCRKQTGCPNAKCINKSCKCYGCS

SEQ ID NO: 1327 - protein, 33 aa, Artificial Sequence
  Definition of Artificial Sequence: Synthetic peptide
SCTGSKDCYAPCRKQTGCPNAKCINKSCKCYGC

SEQ ID NO: 1328 - protein, 34 aa, Artificial Sequence
  Definition of Artificial Sequence: Synthetic peptide
SCTGSKDCYAPCRKQTGCPNAKCINKSCKCYGCS

SEQ ID NO: 1329 - protein, 34 aa, Artificial Sequence
  Definition of Artificial Sequence: Synthetic peptide
VSCTGSKDCYAPCAKQTGCPNAKCINKSCKCYGC

SEQ ID NO: 1330 - protein, 34 aa, Artificial Sequence
  Definition of Artificial Sequence: Synthetic peptide
VSCTGSKDCYAPCRAQTGCPNAKCINKSCKCYGC

SEQ ID NO: 1331 - protein, 34 aa, Artificial Sequence
  Definition of Artificial Sequence: Synthetic peptide
VSCTGSKDCYAPCRKQTGCPNAACINKSCKCYGC

SEQ ID NO: 1332 - protein, 34 aa, Artificial Sequence
  Definition of Artificial Sequence: Synthetic peptide
VSCTGSKDCYAPCRKQTGCPNAKCINASCKCYGC

SEQ ID NO: 1333 - protein, 34 aa, Artificial Sequence
  Definition of Artificial Sequence: Synthetic peptide
VSCTGSKDCYAPCRKQTGCPNAKCINKSCACYGC

SEQ ID NO: 1334 - protein, 34 aa, Artificial Sequence
  Definition of Artificial Sequence: Synthetic peptide
VSCTGSKDCYAPCRKQTGCPNAKCINKSCKCAGC

SEQ ID NO: 1335 - protein, 34 aa, Artificial Sequence
  Definition of Artificial Sequence: Synthetic peptide
ASCTGSKDCYAPCRKQTGCPNAKCINKSCKCYGC

SEQ ID NO: 1336 - protein, 34 aa, Artificial Sequence
  Definition of Artificial Sequence: Synthetic peptide
MSCTGSKDCYAPCRKQTGCPNAKCINKSCKCYGC

SEQ ID NO: 1337 - protein, 219 aa, Artificial Sequence
  Definition of Artificial Sequence: Synthetic protein
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDFRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWQGGA

SEQ ID NO: 1338 - protein, 124 aa, Artificial Sequence
  Definition of Artificial Sequence: Synthetic protein
MAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 1339 - DNA, 1192 bp, Artificial Sequence
  Definition of Artificial Sequence: Synthetic construct
  CDS (4)..(9)
  CDS (66)..(83)
  CDS (87)..(461)
  CDS (487)..(1182)
catatgggtcgagacggggcggtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtccgacggcggcgtctcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1340 - protein, 6 aa, Artificial Sequence
  Definition of Artificial Sequence: Synthetic peptide
YDKVRN

SEQ ID NO: 1341 - protein, 125 aa, Artificial Sequence
  Definition of Artificial Sequence: Synthetic protein
TMAKLTSAVPVLTARDVAGAVEFWTDRLGFSRDFVEDDFAGVVRDDVTLFISAVQDQVVPDNTLAWVWVRGLDELYAEWSEVVSTNFRDASGPAMTEIGEQPWGREFALRDPAGNCVHFVAEEQD

SEQ ID NO: 1342 - protein, 232 aa, Artificial Sequence; identical to SEQ ID NO: 74
  Definition of Artificial Sequence: Synthetic protein

SEQ ID NO: 1343 - DNA, 10 bp, Artificial Sequence
  Definition of Artificial Sequence: Synthetic peptide
aataacatat

SEQ ID NO: 1344 - DNA, 11 bp, Artificial Sequence
  Definition of Artificial Sequence: Synthetic peptide
gggtcgagacg

SEQ ID NO: 1345 - DNA, 14 bp, Artificial Sequence
  Definition of Artificial Sequence: Synthetic peptide
ttattgtataccca

SEQ ID NO: 1346 - DNA, 11 bp, Artificial Sequence
  Definition of Artificial Sequence: Synthetic peptide
gcagagtccac

SEQ ID NO: 1347 - DNA, 73 bp, Artificial Sequence
  Definition of Artificial Sequence: Synthetic peptide
gggtgttatcatcaacgttaaatgcaaaatctcccgtcagtgcctggaaccgtgcaaaaaagctggtatgcgt

SEQ ID NO: 1348 - DNA, 60 bp, Artificial Sequence
  Definition of Artificial Sequence: Synthetic peptide
ttcggtaaatgcatgaacggtaaatgccactgcaccccgaaatctggtggtggtggttct

SEQ ID NO: 1349 - DNA, 73 bp, Artificial Sequence
  Definition of Artificial Sequence: Synthetic peptide
caccagaaccaccaccaccaccagatttcggggtgcagtggcatttaccgttcatgcatttaccgaaacgcat

SEQ ID NO: 1350 - DNA, 133 bp, Artificial Sequence
  Definition of Artificial Sequence: Synthetic oligonucleotide
  CDS (2)..(133)
gggtgttatcatcaacgttaaatgcaaaatctcccgtcagtgcctggaaccgtgcaaaaaagctggtatgcgtttcggtaaatgcatgaacggtaaatgccactgcaccccgaaatctggtggtggtggttct

SEQ ID NO: 1351 - protein, 44 aa, Artificial Sequence
  Definition of Artificial Sequence: Synthetic peptide
GVIINVKCKISRQCLEPCKKAGMRFGKCMNGKCHCTPKSGGGGS

SEQ ID NO: 1352 - DNA, 133 bp, Artificial Sequence
  Definition of Artificial Sequence: Synthetic peptide
caccagaaccaccaccaccagatttcggggtgcagtggcatttaccgttcatgcatttaccgaaacgcataccagcttttttgcacggttccaggcactgacgggagattttgcatttaacgttgatgataac

SEQ ID NO: 1353 - DNA, 83 bp, Artificial Sequence; identical to SEQ ID NO: 763
  Definition of Artificial Sequence: Synthetic peptide

SEQ ID NO: 1354 - DNA, 44 bp, Artificial Sequence; identical to SEQ ID NO: 764
  Definition of Artificial Sequence: Synthetic peptide

SEQ ID NO: 1355 - DNA, 127 bp, Artificial Sequence
  Definition of Artificial Sequence: Synthetic oligonucleotide
  CDS (2)..(127)
gggtcgttcttgtattgatactattccaaaatctcgttgtactgcttttcaatgtaaacattctatgaaatatcgtctttctttttgtcgtaaaacttgtggtacttgttctggtggtggtggttct

SEQ ID NO: 1356 - protein, 42 aa, Artificial Sequence
  Definition of Artificial Sequence: Synthetic peptide
GRSCIDTIPKSRCTAFQCKHSMKYRLSFCRKTCGTCSGGGGS

SEQ ID NO: 1357 - DNA, 127 bp, Artificial Sequence; identical to SEQ ID NO: 767
  Definition of Artificial Sequence: Synthetic peptide

SEQ ID NO: 1358 - DNA, 1530 bp, Artificial Sequence
  Definition of Artificial Sequence: Synthetic construct
  CDS (4)..(702)
  CDS (824)..(1480)
catatggacaaaactcacacatgtccaccttgtccagctccggaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggtggaggtggtggttgagacgctgcaggacgttgatcggcacgtaagaggttccaactttcaccataatgaaataagatcactaccgggcgtattttttgagttatcgagattttcaggagctaaggaagccaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaattccgtatggcaatgaaagacggtgagctggtgatatgggatagtgttcacccttgttacaccgttttccatgagcaaactgaaacgttttcatcgctatggagtgaataccacgacgattcccggcagtttctacacatatattcgcaagatgtggcgtgttacggtgaaaacctggcctatttccctaaagggtttattgagaatatgtttttcgtttcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcggggcggggcgtaatttttttaaggcagttattggtggcgcgcccgtctcttaaggatccg

SEQ ID NO: 1359 - protein, 233 aa, Artificial Sequence; identical to SEQ ID NO: 70
  Definition of Artificial Sequence: Synthetic protein

SEQ ID NO: 1360 - protein, 219 aa, Artificial Sequence
  Definition of Artificial Sequence: Synthetic protein
MEKKITGYTTVDISQWHRKEHFEAFQSVAQCTYNQTVQLDITAFLKTVKKNKHKFYPAFIHILARLMNAHPEFRMAMKDGELVIWDSVHPCYTVFHEQTETFSSLWSEYHDDSRQFLHIYSQDVACYGENLAYFPKGFIENMFFVSANPWVSFTSFDLNVANMDNFFAPVFTMGKYYTQGDKVLMPLAIQVHHAVCDGFHVGRMLNELQQYCDEWRGGA

SEQ ID NO: 1361 - DNA, 1189 bp, Artificial Sequence
  Definition of Artificial Sequence: Synthetic construct
  CDS (4)..(6)
  CDS (87)..(458)
  CDS (484)..(1179)
catatgcgagacggggcggtgttgacaattaatcatcggcatagtatatcggcatagtataatacgacaaggtgaggaactaaaccatggccaagttgaccagtgccgttccggtgctcaccgcgcgcgacgtcgccggagcggtcgagttctggaccgaccggctcgggttctcccgggacttcgtggaggacgacttcgccggtgtggtccgggacgacgtgaccctgttcatcagcgcggtccaggaccaggtggtgccggacaacaccctggcctgggtgtgggtgcgcggcctggacgagctgtacgccgagtggtcggaggtcgtgtccacgaacttccgggacgcctccgggccggccatgaccgagatcggcgagcagccgtgggggcgggagttcgccctgcgcgacccggccggcaactgcgtgcacttcgtggccgaggagcaggactgacacgtccgacggcggcgtctcaggtggtggtggtggtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaataatggatcc

SEQ ID NO: 1362 - protein, 124 aa, Artificial Sequence; identical to SEQ ID NO: 1338
  Definition of Artificial Sequence: Synthetic protein

SEQ ID NO: 1363 - protein, 232 aa, Artificial Sequence; identical to SEQ ID NO: 74
  Definition of Artificial Sequence: Synthetic protein

SEQ ID NO: 1364 - protein, 25 aa, Conus catus
  c-term amidation
CKGKGASCRKTMYDCCRGSCRSGRC

SEQ ID NO: 1365 - protein, 26 aa, Conus catus
  c-term amidation
CKGKGQSCSKLMYDCCTGSCSRRGKC

SEQ ID NO: 1366 - protein, 27 aa, Conus catus
  c-term amidation
CKSKGAKCSKLMYDCCSGSCSGTVGRC

SEQ ID NO: 1367 - protein, 27 aa, Conus tulipa
  MOD_RES (4)..(4): Orn
  MOD_RES (10)..(10): Orn
  MOD_RES (21)..(21): Orn
  c-term amidation
CLSXGSSCSXTSYNCCRSCNXYSRKCY

SEQ ID NO: 1368 - protein, 26 aa, Conus magus
  c-term amidation
CKGKGAPCRKTMYDCCSGSCGRRGKC

SEQ ID NO: 1369 - protein, 37 aa, Artificial Sequence
  Definition of Artificial Sequence: Synthetic peptide
QFTNVSCTTSKECWSVCQRLHNTSRGKCMNGKCRCYS

SEQ ID NO: 1370 - protein, 37 aa, Artificial Sequence
  Definition of Artificial Sequence: Synthetic peptide
QFTNVSCTTSKECLSVCQRLHNTSRGKCMNKKCRCYS

SEQ ID NO: 1371 - protein, 37 aa, Artificial Sequence
  Definition of Artificial Sequence: Synthetic peptide
QFTNVSCTTSKECASVCQRLHNTSRGKCMNKKCRCYS

SEQ ID NO: 1372 - protein, 37 aa, Artificial Sequence
  Definition of Artificial Sequence: Synthetic peptide
QFTNVSCTTSKECWAVCQRLHNTSRGKCMNKKCRCYS

SEQ ID NO: 1373 - protein, 37 aa, Artificial Sequence
  Definition of Artificial Sequence: Synthetic peptide
QFTNVSCTTSKECWPVCQRLHNTSRGKCMNKKCRCYS

SEQ ID NO: 1374 - protein, 37 aa, Artificial Sequence
  Definition of Artificial Sequence: Synthetic peptide
QFTNVSCTTSKECWSACQRLHNTSRGKCMNKKCRCYS

SEQ ID NO: 1375 - protein, 37 aa, Artificial Sequence
  Definition of Artificial Sequence: Synthetic peptide
QFTNVSCTTSKECWSPCQRLHNTSRGKCMNKKCRCYS

SEQ ID NO: 1376 - protein, 37 aa, Artificial Sequence
  Definition of Artificial Sequence: Synthetic peptide
QFTNVSCTTSKECWSVCQRLHNTSAGKCMNKKCRCYS

SEQ ID NO: 1377 - protein, 37 aa, Artificial Sequence
  Definition of Artificial Sequence: Synthetic peptide
QFTNVACTTSKECWSVCQRLHNTSRGKCMNKKCRCYS

SEQ ID NO: 1378 - protein, 37 aa, Artificial Sequence
  Definition of Artificial Sequence: Synthetic peptide
QFTNVKCTTSKECWSVCQRLHNTSRGKCMNKKCRCYS

SEQ ID NO: 1379 - protein, 37 aa, Artificial Sequence
  Definition of Artificial Sequence: Synthetic peptide
QFTNVSCTTAKECWSVCQRLHNTSRGKCMNKKCRCYS

SEQ ID NO: 1380 - protein, 37 aa, Artificial Sequence
  Definition of Artificial Sequence: Synthetic peptide
QFTNVSCTTPKECWSVCQRLHNTSRGKCMNKKCRCYS

SEQ ID NO: 1381 - protein, 37 aa, Artificial Sequence
  Definition of Artificial Sequence: Synthetic peptide
QFTNVSCTTSKACWSVCQRLHNTSRGKCMNKKCRCYS

SEQ ID NO: 1382 - protein, 37 aa, Artificial Sequence
  Definition of Artificial Sequence: Synthetic peptide
QFTNVSCTTSKQCWSVCQRLHNTSRGKCMNKKCRCYS

SEQ ID NO: 1383 - protein, 37 aa, Artificial Sequence
  Definition of Artificial Sequence: Synthetic peptide
AFTNVSCTTSKECWSVCQRLHNTSRGKCMNKKCRCYS

SEQ ID NO: 1384 - protein, 37 aa, Artificial Sequence
  Definition of Artificial Sequence: Synthetic peptide
TFTNVSCTTSKECWSVCQRLHNTSRGKCMNKKCRCYS

SEQ ID NO: 1385 - protein, 37 aa, Artificial Sequence
  Definition of Artificial Sequence: Synthetic peptide
QATNVSCTTSKECWSVCQRLHNTSRGKCMNKKCRCYS

SEQ ID NO: 1386 - protein, 37 aa, Artificial Sequence
  Definition of Artificial Sequence: Synthetic peptide
QITNVSCTTSKECWSVCQRLHNTSRGKCMNKKCRCYS

SEQ ID NO: 1387 - protein, 37 aa, Artificial Sequence
  Definition of Artificial Sequence: Synthetic peptide
QFANVSCTTSKECWSVCQRLHNTSRGKCMNKKCRCYS

SEQ ID NO: 1388 - protein, 37 aa, Artificial Sequence
  Definition of Artificial Sequence: Synthetic peptide
QFINVSCTTSKECWSVCQRLHNTSRGKCMNKKCRCYS

SEQ ID NO: 1389 - protein, 38 aa, Artificial Sequence
  Definition of Artificial Sequence: Synthetic peptide
TIINVKCTSPKQCLPPCKAQFGTSRGKCMNKKCRCYSP

SEQ ID NO: 1390 - protein, 38 aa, Artificial Sequence
  Definition of Artificial Sequence: Synthetic peptide
TIINVSCTSPKQCLPPCKAQFGTSRGKCMNKKCRCYSP

SEQ ID NO: 1391 - protein, 38 aa, Artificial Sequence
  Description of Artificial Sequence: Synthetic peptide
GVIINVKCKISAQCLKPCRDAGMRFGKCMNGKCACTPK

SEQ ID NO: 1392 - protein, 38 aa, Artificial Sequence
  Description of Artificial Sequence: Synthetic peptide
GVIINVKCKISAQCLKPCKDAGMRFGKCMNGKCHCTPK

SEQ ID NO: 1393 - protein, 38 aa, Artificial Sequence
  Description of Artificial Sequence: Synthetic peptide
GVIINVKCKISPQCLKPCKDAGIRFGKCINGKCACTPK

SEQ ID NO: 1394 - protein, 38 aa, Artificial Sequence
  Description of Artificial Sequence: Synthetic peptide
GVIINVKCKISRQCLKPCKEAGMRFGKCMNGKCACTPK

SEQ ID NO: 1395 - protein, 43 aa, Artificial Sequence
  Description of Artificial Sequence: Synthetic peptide
GGGGSGVIINVKCKISRQCLEPCKKAGMRFGKCMNGKCHCTPK

SEQ ID NO: 1396 - protein, 35 aa, Artificial Sequence
  Description of Artificial Sequence: Synthetic peptide
GVIINVKCKISRQCLKPCKDAGMRFGKCMNGKCHC

SEQ ID NO: 1397 - protein, 38 aa, Artificial Sequence
  Description of Artificial Sequence: Synthetic peptide
  MOD_RES (16)..(16): Orn
  MOD_RES (38)..(38): Nle
GVIINVKCKISPQCLXPCKEAGMRFGKCMNGKCHCTYX

SEQ ID NO: 1398 - protein, 38 aa, Artificial Sequence
  Description of Artificial Sequence: Synthetic peptide
  MOD_RES (38)..(38): Nle
GVIINVKCKISPQCLKPCKDAGMRFGKCMNGKCHCTYX

SEQ ID NO: 1399 - protein, 38 aa, Artificial Sequence; identical to SEQ ID NO: 1274
  Description of Artificial Sequence: Synthetic peptide

SEQ ID NO: 1400 - protein, 38 aa, Artificial Sequence
  Description of Artificial Sequence: Synthetic peptide
AVIINVKCKISRQCLEPCKKAGMRFGKCMNGKCHCTPK

SEQ ID NO: 1401 - protein, 38 aa, Artificial Sequence
  Description of Artificial Sequence: Synthetic peptide
GAIINVKCKISRQCLEPCKKAGMRFGKCMNGKCHCTPK

SEQ ID NO: 1402 - protein, 38 aa, Artificial Sequence
  Description of Artificial Sequence: Synthetic peptide
GVAINVKCKISRQCLEPCKKAGMRFGKCMNGKCHCTPK

SEQ ID NO: 1403 - protein, 38 aa, Artificial Sequence
  Description of Artificial Sequence: Synthetic peptide
GVIANVKCKISRQCLEPCKKAGMRFGKCMNGKCHCTPK

SEQ ID NO: 1404 - protein, 38 aa, Artificial Sequence
  Description of Artificial Sequence: Synthetic peptide
GVIIAVKCKISRQCLEPCKKAGMRFGKCMNGKCHCTPK

SEQ ID NO: 1405 - protein, 38 aa, Artificial Sequence
  Description of Artificial Sequence: Synthetic peptide
GVIINAKCKISRQCLEPCKKAGMRFGKCMNGKCHCTPK

SEQ ID NO: 1406 - protein, 38 aa, Artificial Sequence
  Description of Artificial Sequence: Synthetic peptide
GVIINVACKISRQCLEPCKKAGMRFGKCMNGKCHCTPK

SEQ ID NO: 1407 - protein, 38 aa, Artificial Sequence
  Description of Artificial Sequence: Synthetic peptide
GVIINVKCAISRQCLEPCKKAGMRFGKCMNGKCHCTPK

SEQ ID NO: 1408 - protein, 38 aa, Artificial Sequence
  Description of Artificial Sequence: Synthetic peptide
GVIINVKCKASRQCLEPCKKAGMRFGKCMNGKCHCTPK

SEQ ID NO: 1409 - protein, 38 aa, Artificial Sequence
  Description of Artificial Sequence: Synthetic peptide
GVIINVKCKIARQCLEPCKKAGMRFGKCMNGKCHCTPK

SEQ ID NO: 1410 - protein, 38 aa, Artificial Sequence
  Description of Artificial Sequence: Synthetic peptide
GVIINVKCKISAQCLEPCKKAGMRFGKCMNGKCHCTPK

SEQ ID NO: 1411 - protein, 38 aa, Artificial Sequence
  Description of Artificial Sequence: Synthetic peptide
GVIINVKCKISRACLEPCKKAGMRFGKCMNGKCHCTPK

SEQ ID NO: 1412 - protein, 38 aa, Artificial Sequence
  Description of Artificial Sequence: Synthetic peptide
GVIINVKCKISRQCAEPCKKAGMRFGKCMNGKCHCTPK

SEQ ID NO: 1413 - protein, 38 aa, Artificial Sequence
  Description of Artificial Sequence: Synthetic peptide
GVIINVKCKISRQCLAPCKKAGMRFGKCMNGKCHCTPK

SEQ ID NO: 1414 - protein, 38 aa, Artificial Sequence
  Description of Artificial Sequence: Synthetic peptide
GVIINVKCKISRQCLEACKKAGMRFGKCMNGKCHCTPK

SEQ ID NO: 1415 - protein, 38 aa, Artificial Sequence
  Description of Artificial Sequence: Synthetic peptide
GVIINVKCKISRQCLEPCAKAGMRFGKCMNGKCHCTPK

SEQ ID NO: 1416 - protein, 38 aa, Artificial Sequence
  Description of Artificial Sequence: Synthetic peptide
GVIINVKCKISRQCLEPCKAAGMRFGKCMNGKCHCTPK

SEQ ID NO: 1417 - protein, 38 aa, Artificial Sequence; identical to SEQ ID NO: 25
  Description of Artificial Sequence: Synthetic peptide

SEQ ID NO: 1418 - protein, 38 aa, Artificial Sequence
  Description of Artificial Sequence: Synthetic peptide
GVIINVKCKISRQCLEPCKKAAMRFGKCMNGKCHCTPK

SEQ ID NO: 1419 - protein, 38 aa, Artificial Sequence
  Description of Artificial Sequence: Synthetic peptide
GVIINVKCKISRQCLEPCKKAGARFGKCMNGKCHCTPK

SEQ ID NO: 1420 - protein, 38 aa, Artificial Sequence
  Description of Artificial Sequence: Synthetic peptide
GVIINVKCKISRQCLEPCKKAGMAFGKCMNGKCHCTPK

SEQ ID NO: 1421 - protein, 38 aa, Artificial Sequence
  Description of Artificial Sequence: Synthetic peptide
GVIINVKCKISRQCLEPCKKAGMRAGKCMNGKCHCTPK

SEQ ID NO: 1422 - protein, 38 aa, Artificial Sequence
  Description of Artificial Sequence: Synthetic peptide
GVIINVKCKISRQCLEPCKKAGMRFAKCMNGKCHCTPK

SEQ ID NO: 1423 - protein, 38 aa, Artificial Sequence
  Description of Artificial Sequence: Synthetic peptide
GVIINVKCKISRQCLEPCKKAGMRFGACMNGKCHCTPK

SEQ ID NO: 1424 - protein, 38 aa, Artificial Sequence
  Description of Artificial Sequence: Synthetic peptide
GVIINVKCKISRQCLEPCKKAGMRFGKCANGKCHCTPK

SEQ ID NO: 1425 - protein, 38 aa, Artificial Sequence
  Description of Artificial Sequence: Synthetic peptide
GVIINVKCKISRQCLEPCKKAGMRFGKCMAGKCHCTPK

SEQ ID NO: 1426 - protein, 38 aa, Artificial Sequence
  Description of Artificial Sequence: Synthetic peptide
GVIINVKCKISRQCLEPCKKAGMRFGKCMNAKCHCTPK

SEQ ID NO: 1427 - protein, 38 aa, Artificial Sequence
  Description of Artificial Sequence: Synthetic peptide
GVIINVKCKISRQCLEPCKKAGMRFGKCMNGACHCTPK

SEQ ID NO: 1428 - protein, 38 aa, Artificial Sequence; identical to SEQ ID NO: 584
  Description of Artificial Sequence: Synthetic peptide

SEQ ID NO: 1429 - protein, 38 aa, Artificial Sequence
  Description of Artificial Sequence: Synthetic peptide
GVIINVKCKISRQCLEPCKKAGMRFGKCMNGKCHCAPK

SEQ ID NO: 1430 - protein, 38 aa, Artificial Sequence
  Description of Artificial Sequence: Synthetic peptide
GVIINVKCKISRQCLEPCKKAGMRFGKCMNGKCHCTAK

SEQ ID NO: 1431 - protein, 38 aa, Artificial Sequence
  Description of Artificial Sequence: Synthetic peptide
GVIINVKCKISRQCLEPCKKAGMRFGKCMNGKCHCTPA

SEQ ID NO: 1432 - protein, 38 aa, Artificial Sequence
  Description of Artificial Sequence: Synthetic peptide
RVIINVKCKISRQCLEPCKKAGMRFGKCMNGKCHCTPK

SEQ ID NO: 1433 - protein, 38 aa, Artificial Sequence
  Description of Artificial Sequence: Synthetic peptide
GRIINVKCKISRQCLEPCKKAGMRFGKCMNGKCHCTPK

SEQ ID NO: 1434 - protein, 38 aa, Artificial Sequence
  Description of Artificial Sequence: Synthetic peptide
GVRINVKCKISRQCLEPCKKAGMRFGKCMNGKCHCTPK

SEQ ID NO: 1435 - protein, 38 aa, Artificial Sequence
  Description of Artificial Sequence: Synthetic peptide
GVIRNVKCKISRQCLEPCKKAGMRFGKCMNGKCHCTPK

SEQ ID NO: 1436 - protein, 38 aa, Artificial Sequence
  Description of Artificial Sequence: Synthetic peptide
GVIIRVKCKISRQCLEPCKKAGMRFGKCMNGKCHCTPK

SEQ ID NO: 1437 - protein, 38 aa, Artificial Sequence
  Description of Artificial Sequence: Synthetic peptide
GVIINRKCKISRQCLEPCKKAGMRFGKCMNGKCHCTPK

SEQ ID NO: 1438 - protein, 38 aa, Artificial Sequence
  Description of Artificial Sequence: Synthetic peptide
GVIINVRCKISRQCLEPCKKAGMRFGKCMNGKCHCTPK

SEQ ID NO: 1439 - protein, 38 aa, Artificial Sequence
  Description of Artificial Sequence: Synthetic peptide
GVIINVKCRISRQCLEPCKKAGMRFGKCMNGKCHCTPK

SEQ ID NO: 1440 - protein, 38 aa, Artificial Sequence
  Description of Artificial Sequence: Synthetic peptide
GVIINVKCKRSRQCLEPCKKAGMRFGKCMNGKCHCTPK

SEQ ID NO: 1441 - protein, 38 aa, Artificial Sequence
  Description of Artificial Sequence: Synthetic peptide
GVIINVKCKIRRQCLEPCKKAGMRFGKCMNGKCHCTPK

SEQ ID NO: 1442 - protein, 38 aa, Artificial Sequence
  Description of Artificial Sequence: Synthetic peptide
GVIINVKCKISRRCLEPCKKAGMRFGKCMNGKCHCTPK

SEQ ID NO: 1443 - protein, 38 aa, Artificial Sequence
  Description of Artificial Sequence: Synthetic peptide
GVIINVKCKISRQCREPCKKAGMRFGKCMNGKCHCTPK

SEQ ID NO: 1444 - protein, 38 aa, Artificial Sequence
  Description of Artificial Sequence: Synthetic peptide
GVIINVKCKISRQCLRPCKKAGMRFGKCMNGKCHCTPK

SEQ ID NO: 1445 - protein, 38 aa, Artificial Sequence
  Description of Artificial Sequence: Synthetic peptide
GVIINVKCKISRQCLERCKKAGMRFGKCMNGKCHCTPK

SEQ ID NO: 1446 - protein, 38 aa, Artificial Sequence
  Description of Artificial Sequence: Synthetic peptide
GVIINVKCKISRQCLEPCRKAGMRFGKCMNGKCHCTPK

SEQ ID NO: 1447 - protein, 38 aa, Artificial Sequence
  Description of Artificial Sequence: Synthetic peptide
GVIINVKCKISRQCLEPCKRAGMRFGKCMNGKCHCTPK

SEQ ID NO: 1448 - protein, 38 aa, Artificial Sequence
  Description of Artificial Sequence: Synthetic peptide
GVIINVKCKISRQCLEPCKKRGMRFGKCMNGKCHCTPK

SEQ ID NO: 1449 - protein, 38 aa, Artificial Sequence
  Description of Artificial Sequence: Synthetic peptide
GVIINVKCKISRQCLEPCKKARMRFGKCMNGKCHCTPK

SEQ ID NO: 1450 - protein, 38 aa, Artificial Sequence
  Description of Artificial Sequence: Synthetic peptide
GVIINVKCKISRQCLEPCKKAGRRFGKCMNGKCHCTPK

SEQ ID NO: 1451 - protein, 38 aa, Artificial Sequence
  Description of Artificial Sequence: Synthetic peptide
GVIINVKCKISRQCLEPCKKAGMRRGKCMNGKCHCTPK

SEQ ID NO: 1452 - protein, 38 aa, Artificial Sequence
  Description of Artificial Sequence: Synthetic peptide
GVIINVKCKISRQCLEPCKKAGMRFRKCMNGKCHCTPK

SEQ ID NO: 1453 - protein, 38 aa, Artificial Sequence
  Description of Artificial Sequence: Synthetic peptide
GVIINVKCKISRQCLEPCKKAGMRFGRCMNGKCHCTPK

SEQ ID NO: 1454 - protein, 38 aa, Artificial Sequence
  Description of Artificial Sequence: Synthetic peptide
GVIINVKCKISRQCLEPCKKAGMRFGKCRNGKCHCTPK

SEQ ID NO: 1455 - protein, 38 aa, Artificial Sequence
  Description of Artificial Sequence: Synthetic peptide
GVIINVKCKISRQCLEPCKKAGMRFGKCMRGKCHCTPK

SEQ ID NO: 1456 - protein, 38 aa, Artificial Sequence
  Description of Artificial Sequence: Synthetic peptide
GVIINVKCKISRQCLEPCKKAGMRFGKCMNRKCHCTPK

SEQ ID NO: 1457 - protein, 38 aa, Artificial Sequence
  Description of Artificial Sequence: Synthetic peptide
GVIINVKCKISRQCLEPCKKAGMRFGKCMNGRCHCTPK

SEQ ID NO: 1458 - protein, 38 aa, Artificial Sequence
  Description of Artificial Sequence: Synthetic peptide
GVIINVKCKISRQCLEPCKKAGMRFGKCMNGKCRCTPK

SEQ ID NO: 1459 - protein, 38 aa, Artificial Sequence
  Description of Artificial Sequence: Synthetic peptide
GVIINVKCKISRQCLEPCKKAGMRFGKCMNGKCHCRPK

SEQ ID NO: 1460 - protein, 38 aa, Artificial Sequence
  Description of Artificial Sequence: Synthetic peptide
GVIINVKCKISRQCLEPCKKAGMRFGKCMNGKCHCTRK

SEQ ID NO: 1461 - protein, 38 aa, Artificial Sequence
  Description of Artificial Sequence: Synthetic peptide
GVIINVKCKISRQCLEPCKKAGMRFGKCMNGKCHCTPR

SEQ ID NO: 1462 - protein, 38 aa, Artificial Sequence
  Description of Artificial Sequence: Synthetic peptide
EVIINVKCKISRQCLEPCKKAGMRFGKCMNGKCHCTPK

SEQ ID NO: 1463 - protein, 38 aa, Artificial Sequence
  Description of Artificial Sequence: Synthetic peptide
GEIINVKCKISRQCLEPCKKAGMRFGKCMNGKCHCTPK

SEQ ID NO: 1464 - protein, 38 aa, Artificial Sequence
  Description of Artificial Sequence: Synthetic peptide
GVEINVKCKISRQCLEPCKKAGMRFGKCMNGKCHCTPK

SEQ ID NO: 1465 - protein, 38 aa, Artificial Sequence
  Description of Artificial Sequence: Synthetic peptide
GVIENVKCKISRQCLEPCKKAGMRFGKCMNGKCHCTPK

SEQ ID NO: 1466 - protein, 38 aa, Artificial Sequence
  Description of Artificial Sequence: Synthetic peptide
GVIIEVKCKISRQCLEPCKKAGMRFGKCMNGKCHCTPK

SEQ ID NO: 1467 - protein, 38 aa, Artificial Sequence
  Description of Artificial Sequence: Synthetic peptide
GVIINEKCKISRQCLEPCKKAGMRFGKCMNGKCHCTPK

SEQ ID NO: 1468 - protein, 38 aa, Artificial Sequence
  Description of Artificial Sequence: Synthetic peptide
GVIINVECKISRQCLEPCKKAGMRFGKCMNGKCHCTPK

SEQ ID NO: 1469 - protein, 38 aa, Artificial Sequence
  Description of Artificial Sequence: Synthetic peptide
GVIINVKCEISRQCLEPCKKAGMRFGKCMNGKCHCTPK

SEQ ID NO: 1470 - protein, 38 aa, Artificial Sequence
  Description of Artificial Sequence: Synthetic peptide
GVIINVKCKESRQCLEPCKKAGMRFGKCMNGKCHCTPK

SEQ ID NO: 1471 - protein, 38 aa, Artificial Sequence
  Description of Artificial Sequence: Synthetic peptide
GVIINVKCKIERQCLEPCKKAGMRFGKCMNGKCHCTPK

SEQ ID NO: 1472 - protein, 38 aa, Artificial Sequence
  Description of Artificial Sequence: Synthetic peptide
GVIINVKCKISEQCLEPCKKAGMRFGKCMNGKCHCTPK

SEQ ID NO: 1473 - protein, 38 aa, Artificial Sequence
  Description of Artificial Sequence: Synthetic peptide
GVIINVKCKISRECLEPCKKAGMRFGKCMNGKCHCTPK

SEQ ID NO: 1474 - protein, 38 aa, Artificial Sequence
  Description of Artificial Sequence: Synthetic peptide
GVIINVKCKISRQCEEPCKKAGMRFGKCMNGKCHCTPK

SEQ ID NO: 1475 - protein, 38 aa, Artificial Sequence
  Description of Artificial Sequence: Synthetic peptide
GVIINVKCKISRQCLEECKKAGMRFGKCMNGKCHCTPK

SEQ ID NO: 1476 - protein, 38 aa, Artificial Sequence
  Description of Artificial Sequence: Synthetic peptide
GVIINVKCKISRQCLEPCEKAGMRFGKCMNGKCHCTPK

SEQ ID NO: 1477 - protein, 38 aa, Artificial Sequence
  Description of Artificial Sequence: Synthetic peptide
GVIINVKCKISRQCLEPCKEAGMRFGKCMNGKCHCTPK

SEQ ID NO: 1478 - protein, 38 aa, Artificial Sequence
  Description of Artificial Sequence: Synthetic peptide
GVIINVKCKISRQCLEPCKKEGMRFGKCMNGKCHCTPK

SEQ ID NO: 1479 - protein, 38 aa, Artificial Sequence
  Description of Artificial Sequence: Synthetic peptide
GVIINVKCKISRQCLEPCKKAEMRFGKCMNGKCHCTPK

SEQ ID NO: 1480 - protein, 38 aa, Artificial Sequence
  Description of Artificial Sequence: Synthetic peptide
GVIINVKCKISRQCLEPCKKAGERFGKCMNGKCHCTPK

SEQ ID NO: 1481 - protein, 38 aa, Artificial Sequence
  Description of Artificial Sequence: Synthetic peptide
GVIINVKCKISRQCLEPCKKAGMEFGKCMNGKCHCTPK

SEQ ID NO: 1482 - protein, 38 aa, Artificial Sequence
  Description of Artificial Sequence: Synthetic peptide
GVIINVKCKISRQCLEPCKKAGMREGKCMNGKCHCTPK

SEQ ID NO: 1483 - protein, 38 aa, Artificial Sequence
  Description of Artificial Sequence: Synthetic peptide
GVIINVKCKISRQCLEPCKKAGMRFEKCMNGKCHCTPK

SEQ ID NO: 1484 - protein, 38 aa, Artificial Sequence
  Description of Artificial Sequence: Synthetic peptide
GVIINVKCKISRQCLEPCKKAGMRFGECMNGKCHCTPK

SEQ ID NO: 1485 - protein, 38 aa, Artificial Sequence
  Description of Artificial Sequence: Synthetic peptide
GVIINVKCKISRQCLEPCKKAGMRFGKCENGKCHCTPK

SEQ ID NO: 1486 - protein, 38 aa, Artificial Sequence
  Description of Artificial Sequence: Synthetic peptide
GVIINVKCKISRQCLEPCKKAGMRFGKCMEGKCHCTPK

SEQ ID NO: 1487 - protein, 38 aa, Artificial Sequence
  Description of Artificial Sequence: Synthetic peptide
GVIINVKCKISRQCLEPCKKAGMRFGKCMNEKCHCTPK

SEQ ID NO: 1488 - protein, 38 aa, Artificial Sequence
  Description of Artificial Sequence: Synthetic peptide
GVIINVKCKISRQCLEPCKKAGMRFGKCMNGECHCTPK

SEQ ID NO: 1489 - protein, 38 aa, Artificial Sequence
  Description of Artificial Sequence: Synthetic peptide
GVIINVKCKISRQCLEPCKKAGMRFGKCMNGKCECTPK

SEQ ID NO: 1490 - protein, 38 aa, Artificial Sequence
  Description of Artificial Sequence: Synthetic peptide
GVIINVKCKISRQCLEPCKKAGMRFGKCMNGKCHCEPK

SEQ ID NO: 1491 - protein, 38 aa, Artificial Sequence
  Description of Artificial Sequence: Synthetic peptide
GVIINVKCKISRQCLEPCKKAGMRFGKCMNGKCHCTEK

SEQ ID NO: 1492 - protein, 38 aa, Artificial Sequence
  Description of Artificial Sequence: Synthetic peptide
GVIINVKCKISRQCLEPCKKAGMRFGKCMNGKCHCTPE

SEQ ID NO: 1493 - protein, 38 aa, Artificial Sequence
  Description of Artificial Sequence: Synthetic peptide
  MOD_RES (1)..(1): 1-Nal
XVIINVKCKISRQCLEPCKKAGMRFGKCMNGKCHCTPK

SEQ ID NO: 1494 - protein, 38 aa, Artificial Sequence
  Description of Artificial Sequence: Synthetic peptide
  MOD_RES (2)..(2): 1-Nal
GXIINVKCKISRQCLEPCKKAGMRFGKCMNGKCHCTPK

SEQ ID NO: 1495 - protein, 38 aa, Artificial Sequence
  Description of Artificial Sequence: Synthetic peptide
  MOD_RES (3)..(3): 1-Nal
GVXINVKCKISRQCLEPCKKAGMRFGKCMNGKCHCTPK

SEQ ID NO: 1496 - protein, 38 aa, Artificial Sequence
  Description of Artificial Sequence: Synthetic peptide
  MOD_RES (4)..(4): 1-Nal
GVIXNVKCKISRQCLEPCKKAGMRFGKCMNGKCHCTPK

SEQ ID NO: 1497 - protein, 38 aa, Artificial Sequence
  Description of Artificial Sequence: Synthetic peptide
  MOD_RES (5)..(5): 1-Nal
GVIIXVKCKISRQCLEPCKKAGMRFGKCMNGKCHCTPK

SEQ ID NO: 1498 - protein, 38 aa, Artificial Sequence
  Description of Artificial Sequence: Synthetic peptide
  MOD_RES (6)..(6): 1-Nal
GVIINXKCKISRQCLEPCKKAGMRFGKCMNGKCHCTPK

SEQ ID NO: 1499 - protein, 38 aa, Artificial Sequence
  Description of Artificial Sequence: Synthetic peptide
  MOD_RES (7)..(7): 1-Nal
GVIINVXCKISRQCLEPCKKAGMRFGKCMNGKCHCTPK

SEQ ID NO: 1500 - protein, 38 aa, Artificial Sequence
  Description of Artificial Sequence: Synthetic peptide
  MOD_RES (9)..(9): 1-Nal
GVIINVKCXISRQCLEPCKKAGMRFGKCMNGKCHCTPK

SEQ ID NO: 1501 - protein, 38 aa, Artificial Sequence
  Description of Artificial Sequence: Synthetic peptide
  MOD_RES (10)..(10): 1-Nal
GVIINVKCKXSRQCLEPCKKAGMRFGKCMNGKCHCTPK

SEQ ID NO: 1502 - protein, 38 aa, Artificial Sequence
  Description of Artificial Sequence: Synthetic peptide
  MOD_RES (11)..(11): 1-Nal
GVIINVKCKIXRQCLEPCKKAGMRFGKCMNGKCHCTPK

SEQ ID NO: 1503 - protein, 38 aa, Artificial Sequence
  Description of Artificial Sequence: Synthetic peptide
  MOD_RES (12)..(12): 1-Nal
GVIINVKCKISXQCLEPCKKAGMRFGKCMNGKCHCTPK

SEQ ID NO: 1504 - protein, 38 aa, Artificial Sequence
  Description of Artificial Sequence: Synthetic peptide
  MOD_RES (13)..(13): 1-Nal
GVIINVKCKISRXCLEPCKKAGMRFGKCMNGKCHCTPK

SEQ ID NO: 1505 - protein, 38 aa, Artificial Sequence
  Description of Artificial Sequence: Synthetic peptide
  MOD_RES (15)..(15): 1-Nal
GVIINVKCKISRQCXEPCKKAGMRFGKCMNGKCHCTPK

SEQ ID NO: 1506 - protein, 38 aa, Artificial Sequence
  Description of Artificial Sequence: Synthetic peptide
  MOD_RES (16)..(16): 1-Nal
GVIINVKCKISRQCLXPCKKAGMRFGKCMNGKCHCTPK

SEQ ID NO: 1507 - protein, 38 aa, Artificial Sequence
  Description of Artificial Sequence: Synthetic peptide
  MOD_RES (17)..(17): 1-Nal
GVIINVKCKISRQCLEXCKKAGMRFGKCMNGKCHCTPK

SEQ ID NO: 1508 - protein, 38 aa, Artificial Sequence
  Description of Artificial Sequence: Synthetic peptide
  MOD_RES (19)..(19): 1-Nal
GVIINVKCKISRQCLEPCXKAGMRFGKCMNGKCHCTPK

SEQ ID NO: 1509 - protein, 38 aa, Artificial Sequence
  Description of Artificial Sequence: Synthetic peptide
  MOD_RES (20)..(20): 1-Nal
GVIINVKCKISRQCLEPCKXAGMRFGKCMNGKCHCTPK

SEQ ID NO: 1510 - protein, 38 aa, Artificial Sequence
  Description of Artificial Sequence: Synthetic peptide
  MOD_RES (21)..(21): 1-Nal
GVIINVKCKISRQCLEPCKKXGMRFGKCMNGKCHCTPK

SEQ ID NO: 1511 - protein, 38 aa, Artificial Sequence
  Description of Artificial Sequence: Synthetic peptide
  MOD_RES (22)..(22): 1-Nal
GVIINVKCKISRQCLEPCKKAXMRFGKCMNGKCHCTPK

SEQ ID NO: 1512 - protein, 38 aa, Artificial Sequence
  Description of Artificial Sequence: Synthetic peptide
  MOD_RES (23)..(23): 1-Nal
GVIINVKCKISRQCLEPCKKAGXRFGKCMNGKCHCTPK

SEQ ID NO: 1513 - protein, 38 aa, Artificial Sequence
  Description of Artificial Sequence: Synthetic peptide
  MOD_RES (24)..(24): 1-Nal
GVIINVKCKISRQCLEPCKKAGMXFGKCMNGKCHCTPK

SEQ ID NO: 1514 - protein, 38 aa, Artificial Sequence
  Description of Artificial Sequence: Synthetic peptide
  MOD_RES (25)..(25): 1-Nal
GVIINVKCKISRQCLEPCKKAGMRXGKCMNGKCHCTPK

SEQ ID NO: 1515 - protein, 38 aa, Artificial Sequence
  Description of Artificial Sequence: Synthetic peptide
  MOD_RES (26)..(26): 1-Nal
GVIINVKCKISRQCLEPCKKAGMRFXKCMNGKCHCTPK

SEQ ID NO: 1516 - protein, 38 aa, Artificial Sequence
  Description of Artificial Sequence: Synthetic peptide
  MOD_RES (27)..(27): 1-Nal
GVIINVKCKISRQCLEPCKKAGMRFGXCMNGKCHCTPK

SEQ ID NO: 1517 - protein, 38 aa, Artificial Sequence
  Description of Artificial Sequence: Synthetic peptide
  MOD_RES (29)..(29): 1-Nal
GVIINVKCKISRQCLEPCKKAGMRFGKCXNGKCHCTPK

SEQ ID NO: 1518 - protein, 38 aa, Artificial Sequence
  Description of Artificial Sequence: Synthetic peptide
  MOD_RES (30)..(30): 1-Nal
GVIINVKCKISRQCLEPCKKAGMRFGKCMXGKCHCTPK

SEQ ID NO: 1519 - protein, 38 aa, Artificial Sequence
  Description of Artificial Sequence: Synthetic peptide
  MOD_RES (31)..(31): 1-Nal
GVIINVKCKISRQCLEPCKKAGMRFGKCMNXKCHCTPK

SEQ ID NO: 1520 - protein, 38 aa, Artificial Sequence
  Description of Artificial Sequence: Synthetic peptide
  MOD_RES (32)..(32): 1-Nal
GVIINVKCKISRQCLEPCKKAGMRFGKCMNGXCHCTPK

SEQ ID NO: 1521 - protein, 38 aa, Artificial Sequence
  Description of Artificial Sequence: Synthetic peptide
  MOD_RES (34)..(34): 1-Nal
GVIINVKCKISRQCLEPCKKAGMRFGKCMNGKCXCTPK

SEQ ID NO: 1522 - protein, 38 aa, Artificial Sequence
  Description of Artificial Sequence: Synthetic peptide
  MOD_RES (36)..(36): 1-Nal
GVIINVKCKISRQCLEPCKKAGMRFGKCMNGKCHCXPK

SEQ ID NO: 1523 - protein, 38 aa, Artificial Sequence
  Description of Artificial Sequence: Synthetic peptide
  MOD_RES (37)..(37): 1-Nal
GVIINVKCKISRQCLEPCKKAGMRFGKCMNGKCHCTXK

SEQ ID NO: 1524 - protein, 38 aa, Artificial Sequence
  Description of Artificial Sequence: Synthetic peptide
  MOD_RES (38)..(38): 1-Nal
GVIINVKCKISRQCLEPCKKAGMRFGKCMNGKCHCTPX

SEQ ID NO: 1525 - protein, 38 aa, Artificial Sequence; identical to SEQ ID NO: 1400
  Description of Artificial Sequence: Synthetic peptide
  n-term acetylation

SEQ ID NO: 1526 - protein, 38 aa, Artificial Sequence; identical to SEQ ID NO: 1401
  Description of Artificial Sequence: Synthetic peptide
  n-term acetylation

SEQ ID NO: 1527 - protein, 38 aa, Artificial Sequence; identical to SEQ ID NO: 1402
  Description of Artificial Sequence: Synthetic peptide
  n-term acetylation

SEQ ID NO: 1528 - protein, 38 aa, Artificial Sequence; identical to SEQ ID NO: 1403
  Description of Artificial Sequence: Synthetic peptide
  n-term acetylation

SEQ ID NO: 1529 - protein, 38 aa, Artificial Sequence; identical to SEQ ID NO: 1404
  Description of Artificial Sequence: Synthetic peptide
  n-term acetylation

SEQ ID NO: 1530 - protein, 38 aa, Artificial Sequence; identical to SEQ ID NO: 1405
  Description of Artificial Sequence: Synthetic peptide
  n-term acetylation

SEQ ID NO: 1531 - protein, 38 aa, Artificial Sequence; identical to SEQ ID NO: 1406
  Description of Artificial Sequence: Synthetic peptide
  n-term acetylation

SEQ ID NO: 1532 - protein, 38 aa, Artificial Sequence; identical to SEQ ID NO: 1407
  Description of Artificial Sequence: Synthetic peptide
  n-term acetylation

SEQ ID NO: 1533 - protein, 38 aa, Artificial Sequence; identical to SEQ ID NO: 1408
  Description of Artificial Sequence: Synthetic peptide
  n-term acetylation

SEQ ID NO: 1534 - protein, 38 aa, Artificial Sequence; identical to SEQ ID NO: 1409
  Description of Artificial Sequence: Synthetic peptide
  n-term acetylation

SEQ ID NO: 1535 - protein, 38 aa, Artificial Sequence; identical to SEQ ID NO: 1410
  Description of Artificial Sequence: Synthetic peptide
  n-term acetylation

SEQ ID NO: 1536 - protein, 38 aa, Artificial Sequence; identical to SEQ ID NO: 1411
  Description of Artificial Sequence: Synthetic peptide
  n-term acetylation

SEQ ID NO: 1537 - protein, 38 aa, Artificial Sequence; identical to SEQ ID NO: 1412
  Description of Artificial Sequence: Synthetic peptide
  n-term acetylation

SEQ ID NO: 1538 - protein, 38 aa, Artificial Sequence; identical to SEQ ID NO: 1413
  Description of Artificial Sequence: Synthetic peptide
  n-term acetylation

SEQ ID NO: 1539 - protein, 38 aa, Artificial Sequence; identical to SEQ ID NO: 1414
  Description of Artificial Sequence: Synthetic peptide
  n-term acetylation

SEQ ID NO: 1540 - protein, 38 aa, Artificial Sequence; identical to SEQ ID NO: 1415
  Description of Artificial Sequence: Synthetic peptide
  n-term acetylation

SEQ ID NO: 1541 - protein, 38 aa, Artificial Sequence; identical to SEQ ID NO: 1416
  Description of Artificial Sequence: Synthetic peptide
  n-term acetylation

SEQ ID NO: 1542 - protein, 38 aa, Artificial Sequence; identical to SEQ ID NO: 1418
  Description of Artificial Sequence: Synthetic peptide
  n-term acetylation

SEQ ID NO: 1543 - protein, 38 aa, Artificial Sequence; identical to SEQ ID NO: 1419
  Description of Artificial Sequence: Synthetic peptide
  n-term acetylation

SEQ ID NO: 1544 - protein, 38 aa, Artificial Sequence; identical to SEQ ID NO: 1420
  Description of Artificial Sequence: Synthetic peptide
  n-term acetylation

SEQ ID NO: 1545 - protein, 38 aa, Artificial Sequence; identical to SEQ ID NO: 1421
  Description of Artificial Sequence: Synthetic peptide
  n-term acetylation

SEQ ID NO: 1546 - protein, 38 aa, Artificial Sequence; identical to SEQ ID NO: 1422
  Description of Artificial Sequence: Synthetic peptide
  n-term acetylation

SEQ ID NO: 1547 - protein, 38 aa, Artificial Sequence; identical to SEQ ID NO: 1423
  Description of Artificial Sequence: Synthetic peptide
  n-term acetylation

SEQ ID NO: 1548 - protein, 38 aa, Artificial Sequence; identical to SEQ ID NO: 1424
  Description of Artificial Sequence: Synthetic peptide
  n-term acetylation

SEQ ID NO: 1549 - protein, 38 aa, Artificial Sequence; identical to SEQ ID NO: 1425
  Description of Artificial Sequence: Synthetic peptide
  n-term acetylation

SEQ ID NO: 1550 - protein, 38 aa, Artificial Sequence; identical to SEQ ID NO: 1426
  Description of Artificial Sequence: Synthetic peptide
  n-term acetylation

SEQ ID NO: 1551 - protein, 38 aa, Artificial Sequence; identical to SEQ ID NO: 1427
  Description of Artificial Sequence: Synthetic peptide
  n-term acetylation

SEQ ID NO: 1552 - protein, 38 aa, Artificial Sequence; identical to SEQ ID NO: 584
  Description of Artificial Sequence: Synthetic peptide
  n-term acetylation

SEQ ID NO: 1553 - protein, 38 aa, Artificial Sequence; identical to SEQ ID NO: 1429
  Description of Artificial Sequence: Synthetic peptide
  n-term acetylation

SEQ ID NO: 1554 - protein, 38 aa, Artificial Sequence; identical to SEQ ID NO: 1430
  Description of Artificial Sequence: Synthetic peptide
  n-term acetylation

SEQ ID NO: 1555 - protein, 38 aa, Artificial Sequence; identical to SEQ ID NO: 1431
  Description of Artificial Sequence: Synthetic peptide
  n-term acetylation

SEQ ID NO: 1556 - protein, 38 aa, Artificial Sequence; identical to SEQ ID NO: 1432
  Description of Artificial Sequence: Synthetic peptide
  n-term acetylation

SEQ ID NO: 1557 - protein, 38 aa, Artificial Sequence; identical to SEQ ID NO: 1433
  Description of Artificial Sequence: Synthetic peptide
  n-term acetylation

SEQ ID NO: 1558 - protein, 38 aa, Artificial Sequence; identical to SEQ ID NO: 1434
  Description of Artificial Sequence: Synthetic peptide
  n-term acetylation

SEQ ID NO: 1559 - protein, 38 aa, Artificial Sequence; identical to SEQ ID NO: 1435
  Description of Artificial Sequence: Synthetic peptide
  n-term acetylation

SEQ ID NO: 1560 - protein, 38 aa, Artificial Sequence; identical to SEQ ID NO: 1436
  Description of Artificial Sequence: Synthetic peptide
  n-term acetylation

SEQ ID NO: 1561 - protein, 38 aa, Artificial Sequence; identical to SEQ ID NO: 1437
  Description of Artificial Sequence: Synthetic peptide
  n-term acetylation

SEQ ID NO: 1562 - protein, 38 aa, Artificial Sequence; identical to SEQ ID NO: 1438
  Description of Artificial Sequence: Synthetic peptide
  n-term acetylation

SEQ ID NO: 1563 - protein, 38 aa, Artificial Sequence; identical to SEQ ID NO: 1439
  Description of Artificial Sequence: Synthetic peptide
  n-term acetylation

SEQ ID NO: 1564 - protein, 38 aa, Artificial Sequence; identical to SEQ ID NO: 1440
  Description of Artificial Sequence: Synthetic peptide
  n-term acetylation

SEQ ID NO: 1565 - protein, 38 aa, Artificial Sequence; identical to SEQ ID NO: 1441
  Description of Artificial Sequence: Synthetic peptide
  n-term acetylation

SEQ ID NO: 1566 - protein, 38 aa, Artificial Sequence; identical to SEQ ID NO: 1442
  Description of Artificial Sequence: Synthetic peptide
  n-term acetylation

SEQ ID NO: 1567 - protein, 38 aa, Artificial Sequence; identical to SEQ ID NO: 1443
  Description of Artificial Sequence: Synthetic peptide
  n-term acetylation

SEQ ID NO: 1568 - protein, 38 aa, Artificial Sequence; identical to SEQ ID NO: 1444
  Description of Artificial Sequence: Synthetic peptide
  n-term acetylation

SEQ ID NO: 1569 - protein, 38 aa, Artificial Sequence; identical to SEQ ID NO: 1445
  Description of Artificial Sequence: Synthetic peptide
  n-term acetylation

SEQ ID NO: 1570 - protein, 38 aa, Artificial Sequence; identical to SEQ ID NO: 1446
  Description of Artificial Sequence: Synthetic peptide
  n-term acetylation

SEQ ID NO: 1571 - protein, 38 aa, Artificial Sequence; identical to SEQ ID NO: 1447
  Description of Artificial Sequence: Synthetic peptide
  n-term acetylation

SEQ ID NO: 1572 - protein, 38 aa, Artificial Sequence; identical to SEQ ID NO: 1448
  Description of Artificial Sequence: Synthetic peptide
  n-term acetylation

SEQ ID NO: 1573 - protein, 38 aa, Artificial Sequence; identical to SEQ ID NO: 1449
  Description of Artificial Sequence: Synthetic peptide
  n-term acetylation

SEQ ID NO: 1574 - protein, 38 aa, Artificial Sequence; identical to SEQ ID NO: 1450
  Description of Artificial Sequence: Synthetic peptide
  n-term acetylation

SEQ ID NO: 1575 - protein, 38 aa, Artificial Sequence; identical to SEQ ID NO: 1451
  Description of Artificial Sequence: Synthetic peptide
  n-term acetylation

SEQ ID NO: 1576 - protein, 38 aa, Artificial Sequence; identical to SEQ ID NO: 1452
  Description of Artificial Sequence: Synthetic peptide
  n-term acetylation

SEQ ID NO: 1577 - protein, 38 aa, Artificial Sequence; identical to SEQ ID NO: 1453
  Description of Artificial Sequence: Synthetic peptide
  n-term acetylation

SEQ ID NO: 1578 - protein, 38 aa, Artificial Sequence; identical to SEQ ID NO: 1454
  Description of Artificial Sequence: Synthetic peptide
  n-term acetylation

SEQ ID NO: 1579 - protein, 38 aa, Artificial Sequence; identical to SEQ ID NO: 1455
  Description of Artificial Sequence: Synthetic peptide
  n-term acetylation

SEQ ID NO: 1580 - protein, 38 aa, Artificial Sequence; identical to SEQ ID NO: 1456
  Description of Artificial Sequence: Synthetic peptide
  n-term acetylation

SEQ ID NO: 1581 - protein, 38 aa, Artificial Sequence; identical to SEQ ID NO: 1457
  Description of Artificial Sequence: Synthetic peptide
  n-term acetylation

SEQ ID NO: 1582 - protein, 38 aa, Artificial Sequence; identical to SEQ ID NO: 1458
  Description of Artificial Sequence: Synthetic peptide
  n-term acetylation

SEQ ID NO: 1583 - protein, 38 aa, Artificial Sequence; identical to SEQ ID NO: 1459
  Description of Artificial Sequence: Synthetic peptide
  n-term acetylation

SEQ ID NO: 1584 - protein, 38 aa, Artificial Sequence; identical to SEQ ID NO: 1460
  Description of Artificial Sequence: Synthetic peptide
  n-term acetylation

SEQ ID NO: 1585 - protein, 38 aa, Artificial Sequence; identical to SEQ ID NO: 1461
  Description of Artificial Sequence: Synthetic peptide
  n-term acetylation

SEQ ID NO: 1586 - protein, 38 aa, Artificial Sequence; identical to SEQ ID NO: 1462
  Description of Artificial Sequence: Synthetic peptide
  n-term acetylation

SEQ ID NO: 1587 - protein, 38 aa, Artificial Sequence; identical to SEQ ID NO: 1463
  Description of Artificial Sequence: Synthetic peptide
  n-term acetylation

SEQ ID NO: 1588 - protein, 38 aa, Artificial Sequence; identical to SEQ ID NO: 1464
  Description of Artificial Sequence: Synthetic peptide
  n-term acetylation

SEQ ID NO: 1589 - protein, 38 aa, Artificial Sequence; identical to SEQ ID NO: 1465
  Description of Artificial Sequence: Synthetic peptide
  n-term acetylation

SEQ ID NO: 1590 - protein, 38 aa, Artificial Sequence; identical to SEQ ID NO: 1466
  Description of Artificial Sequence: Synthetic peptide
  n-term acetylation

SEQ ID NO: 1591 - protein, 38 aa, Artificial Sequence; identical to SEQ ID NO: 1467
  Description of Artificial Sequence: Synthetic peptide
  n-term acetylation

SEQ ID NO: 1592 - protein, 38 aa, Artificial Sequence; identical to SEQ ID NO: 1468
  Description of Artificial Sequence: Synthetic peptide
  n-term acetylation

SEQ ID NO: 1593 - protein, 38 aa, Artificial Sequence; identical to SEQ ID NO: 1469
  Description of Artificial Sequence: Synthetic peptide
  n-term acetylation

SEQ ID NO: 1594 - protein, 38 aa, Artificial Sequence; identical to SEQ ID NO: 1470
  Description of Artificial Sequence: Synthetic peptide
  n-term acetylation

SEQ ID NO: 1595 - protein, 38 aa, Artificial Sequence; identical to SEQ ID NO: 1471
  Description of Artificial Sequence: Synthetic peptide
  n-term acetylation

SEQ ID NO: 1596 - protein, 38 aa, Artificial Sequence; identical to SEQ ID NO: 1472
  Description of Artificial Sequence: Synthetic peptide
  n-term acetylation

SEQ ID NO: 1597 - protein, 38 aa, Artificial Sequence; identical to SEQ ID NO: 1473
  Description of Artificial Sequence: Synthetic peptide
  n-term acetylation

SEQ ID NO: 1598 - protein, 38 aa, Artificial Sequence; identical to SEQ ID NO: 1474
  Description of Artificial Sequence: Synthetic peptide
  n-term acetylation

SEQ ID NO: 1599 - protein, 38 aa, Artificial Sequence; identical to SEQ ID NO: 1475
  Description of Artificial Sequence: Synthetic peptide
  n-term acetylation

SEQ ID NO: 1600 - protein, 38 aa, Artificial Sequence; identical to SEQ ID NO: 1476
  Description of Artificial Sequence: Synthetic peptide
  n-term acetylation

SEQ ID NO: 1601 - protein, 38 aa, Artificial Sequence; identical to SEQ ID NO: 1477
  Description of Artificial Sequence: Synthetic peptide
  n-term acetylation

SEQ ID NO: 1602 - protein, 38 aa, Artificial Sequence; identical to SEQ ID NO: 1478
  Description of Artificial Sequence: Synthetic peptide
  n-term acetylation

SEQ ID NO: 1603 - protein, 38 aa, Artificial Sequence; identical to SEQ ID NO: 1479
  Description of Artificial Sequence: Synthetic peptide
  n-term acetylation

SEQ ID NO: 1604 - protein, 38 aa, Artificial Sequence; identical to SEQ ID NO: 1480
  Description of Artificial Sequence: Synthetic peptide
  n-term acetylation

SEQ ID NO: 1605 - protein, 38 aa, Artificial Sequence; identical to SEQ ID NO: 1481
  Description of Artificial Sequence: Synthetic peptide
  n-term acetylation

SEQ ID NO: 1606 - protein, 38 aa, Artificial Sequence; identical to SEQ ID NO: 1482
  Description of Artificial Sequence: Synthetic peptide
  n-term acetylation

SEQ ID NO: 1607 - protein, 38 aa, Artificial Sequence; identical to SEQ ID NO: 1483
  Description of Artificial Sequence: Synthetic peptide
  n-term acetylation

SEQ ID NO: 1608 - protein, 38 aa, Artificial Sequence; identical to SEQ ID NO: 1484
  Description of Artificial Sequence: Synthetic peptide
  n-term acetylation

SEQ ID NO: 1609 - protein, 38 aa, Artificial Sequence; identical to SEQ ID NO: 1485
  Description of Artificial Sequence: Synthetic peptide
  n-term acetylation

SEQ ID NO: 1610 - protein, 38 aa, Artificial Sequence; identical to SEQ ID NO: 1486
  Description of Artificial Sequence: Synthetic peptide
  n-term acetylation

SEQ ID NO: 1611 - protein, 38 aa, Artificial Sequence; identical to SEQ ID NO: 1487
  Description of Artificial Sequence: Synthetic peptide
  n-term acetylation

SEQ ID NO: 1612 - protein, 38 aa, Artificial Sequence; identical to SEQ ID NO: 1488
  Description of Artificial Sequence: Synthetic peptide
  n-term acetylation

SEQ ID NO: 1613 - protein, 38 aa, Artificial Sequence; identical to SEQ ID NO: 1489
  Description of Artificial Sequence: Synthetic peptide
  n-term acetylation

SEQ ID NO: 1614 - protein, 38 aa, Artificial Sequence; identical to SEQ ID NO: 1490
  Description of Artificial Sequence: Synthetic peptide
  n-term acetylation

SEQ ID NO: 1615 - protein, 38 aa, Artificial Sequence; identical to SEQ ID NO: 1491
  Description of Artificial Sequence: Synthetic peptide
  n-term acetylation

SEQ ID NO: 1616 - protein, 38 aa, Artificial Sequence; identical to SEQ ID NO: 1492
  Description of Artificial Sequence: Synthetic peptide
  n-term acetylation

SEQ ID NO: 1617 - protein, 38 aa, Artificial Sequence; identical to SEQ ID NO: 1493
  Description of Artificial Sequence: Synthetic peptide
  MOD_RES (1)..(1): 1-Nal
  n-term acetylation

SEQ ID NO: 1618 - protein, 38 aa, Artificial Sequence; identical to SEQ ID NO: 1494
  Description of Artificial Sequence: Synthetic peptide
  MOD_RES (2)..(2): 1-Nal
  n-term acetylation

SEQ ID NO: 1619 - protein, 38 aa, Artificial Sequence; identical to SEQ ID NO: 1495
  Description of Artificial Sequence: Synthetic peptide
  MOD_RES (3)..(3): 1-Nal
  n-term acetylation

SEQ ID NO: 1620 - protein, 38 aa, Artificial Sequence; identical to SEQ ID NO: 1496
  Description of Artificial Sequence: Synthetic peptide
  MOD_RES (4)..(4): 1-Nal
  n-term acetylation

SEQ ID NO: 1621 - protein, 38 aa, Artificial Sequence; identical to SEQ ID NO: 1497
  Description of Artificial Sequence: Synthetic peptide
  MOD_RES (5)..(5): 1-Nal
  n-term acetylation

SEQ ID NO: 1622 - protein, 38 aa, Artificial Sequence; identical to SEQ ID NO: 1498
  Description of Artificial Sequence: Synthetic peptide
  MOD_RES (6)..(6): 1-Nal
  n-term acetylation

SEQ ID NO: 1623 - protein, 38 aa, Artificial Sequence; identical to SEQ ID NO: 1499
  Description of Artificial Sequence: Synthetic peptide
  MOD_RES (7)..(7): 1-Nal
  n-term acetylation

SEQ ID NO: 1624 - protein, 38 aa, Artificial Sequence; identical to SEQ ID NO: 1500
  Description of Artificial Sequence: Synthetic peptide
  MOD_RES (9)..(9): 1-Nal
  n-term acetylation

SEQ ID NO: 1625 - protein, 38 aa, Artificial Sequence; identical to SEQ ID NO: 1501
  Description of Artificial Sequence: Synthetic peptide
  MOD_RES (10)..(10): 1-Nal
  n-term acetylation

SEQ ID NO: 1626 - protein, 38 aa, Artificial Sequence; identical to SEQ ID NO: 1502
  Description of Artificial Sequence: Synthetic peptide
  MOD_RES (11)..(11): 1-Nal
  n-term acetylation

SEQ ID NO: 1627 - protein, 38 aa, Artificial Sequence; identical to SEQ ID NO: 1503
  Description of Artificial Sequence: Synthetic peptide
  MOD_RES (12)..(12): 1-Nal
  n-term acetylation

SEQ ID NO: 1628 - protein, 38 aa, Artificial Sequence; identical to SEQ ID NO: 1504
  Description of Artificial Sequence: Synthetic peptide
  MOD_RES (13)..(13): 1-Nal
  n-term acetylation

SEQ ID NO: 1629 - protein, 38 aa, Artificial Sequence; identical to SEQ ID NO: 1505
  Description of Artificial Sequence: Synthetic peptide
  MOD_RES (15)..(15): 1-Nal
  n-term acetylation

SEQ ID NO: 1630 - protein, 38 aa, Artificial Sequence; identical to SEQ ID NO: 1506
  Description of Artificial Sequence: Synthetic peptide
  MOD_RES (16)..(16): 1-Nal
  n-term acetylation

SEQ ID NO: 1631 - protein, 38 aa, Artificial Sequence; identical to SEQ ID NO: 1507
  Description of Artificial Sequence: Synthetic peptide
  MOD_RES (17)..(17): 1-Nal
  n-term acetylation

SEQ ID NO: 1632 - protein, 38 aa, Artificial Sequence; identical to SEQ ID NO: 1508
  Description of Artificial Sequence: Synthetic peptide
  MOD_RES (19)..(19): 1-Nal
  n-term acetylation

SEQ ID NO: 1633 - protein, 38 aa, Artificial Sequence; identical to SEQ ID NO: 1509
  Description of Artificial Sequence: Synthetic peptide
  MOD_RES (20)..(20): 1-Nal
  n-term acetylation

SEQ ID NO: 1634 - protein, 38 aa, Artificial Sequence; identical to SEQ ID NO: 1510
  Description of Artificial Sequence: Synthetic peptide
  MOD_RES (21)..(21): 1-Nal
  n-term acetylation

SEQ ID NO: 1635 - protein, 38 aa, Artificial Sequence; identical to SEQ ID NO: 1511
  Description of Artificial Sequence: Synthetic peptide
  MOD_RES (22)..(22): 1-Nal
  n-term acetylation

SEQ ID NO: 1636 - protein, 38 aa, Artificial Sequence; identical to SEQ ID NO: 1512
  Description of Artificial Sequence: Synthetic peptide
  MOD_RES (23)..(23): 1-Nal
  n-term acetylation

SEQ ID NO: 1637 - protein, 38 aa, Artificial Sequence; identical to SEQ ID NO: 1513
  Description of Artificial Sequence: Synthetic peptide
  MOD_RES (24)..(24): 1-Nal
  n-term acetylation

SEQ ID NO: 1638 - protein, 38 aa, Artificial Sequence; identical to SEQ ID NO: 1514
  Description of Artificial Sequence: Synthetic peptide
  MOD_RES (25)..(25): 1-Nal
  n-term acetylation

SEQ ID NO: 1639 - protein, 38 aa, Artificial Sequence; identical to SEQ ID NO: 1515
  Description of Artificial Sequence: Synthetic peptide
  MOD_RES (26)..(26): 1-Nal
  n-term acetylation

SEQ ID NO: 1640 - protein, 38 aa, Artificial Sequence; identical to SEQ ID NO: 1516
  Description of Artificial Sequence: Synthetic peptide
  MOD_RES (27)..(27): 1-Nal
  n-term acetylation

SEQ ID NO: 1641 - protein, 38 aa, Artificial Sequence; identical to SEQ ID NO: 1517
  Description of Artificial Sequence: Synthetic peptide
  MOD_RES (29)..(29): 1-Nal
  n-term acetylation

SEQ ID NO: 1642 - protein, 38 aa, Artificial Sequence; identical to SEQ ID NO: 1518
  Description of Artificial Sequence: Synthetic peptide
  MOD_RES (30)..(30): 1-Nal
  n-term acetylation

SEQ ID NO: 1643 - protein, 38 aa, Artificial Sequence; identical to SEQ ID NO: 1519
  Description of Artificial Sequence: Synthetic peptide
  MOD_RES (31)..(31): 1-Nal
  n-term acetylation

SEQ ID NO: 1644 - protein, 38 aa, Artificial Sequence; identical to SEQ ID NO: 1520
  Description of Artificial Sequence: Synthetic peptide
  MOD_RES (32)..(32): 1-Nal
  n-term acetylation

SEQ ID NO: 1645 - protein, 38 aa, Artificial Sequence; identical to SEQ ID NO: 1521
  Description of Artificial Sequence: Synthetic peptide
  MOD_RES (34)..(34): 1-Nal
  n-term acetylation

SEQ ID NO: 1646 - protein, 38 aa, Artificial Sequence; identical to SEQ ID NO: 1522
  Description of Artificial Sequence: Synthetic peptide
  MOD_RES (36)..(36): 1-Nal
  n-term acetylation

SEQ ID NO: 1647 - protein, 38 aa, Artificial Sequence; identical to SEQ ID NO: 1523
  Description of Artificial Sequence: Synthetic peptide
  MOD_RES (37)..(37): 1-Nal
  n-term acetylation

SEQ ID NO: 1648 - protein, 38 aa, Artificial Sequence; identical to SEQ ID NO: 1524
  Description of Artificial Sequence: Synthetic peptide
  MOD_RES (38)..(38): 1-Nal
  n-term acetylation

SEQ ID NO: 1649 - protein, 38 aa, Artificial Sequence; identical to SEQ ID NO: 1400
  Description of Artificial Sequence: Synthetic peptide
  c-term amidation

SEQ ID NO: 1650 - protein, 38 aa, Artificial Sequence; identical to SEQ ID NO: 1401
  Description of Artificial Sequence: Synthetic peptide
  c-term amidation

SEQ ID NO: 1651 - protein, 38 aa, Artificial Sequence; identical to SEQ ID NO: 1402
  Description of Artificial Sequence: Synthetic peptide
  c-term amidation

SEQ ID NO: 1652 - protein, 38 aa, Artificial Sequence; identical to SEQ ID NO: 1403
  Description of Artificial Sequence: Synthetic peptide
  c-term amidation

SEQ ID NO: 1653 - protein, 38 aa, Artificial Sequence; identical to SEQ ID NO: 1404
  Description of Artificial Sequence: Synthetic peptide
  c-term amidation

SEQ ID NO: 1654 - protein, 38 aa, Artificial Sequence; identical to SEQ ID NO: 1405
  Description of Artificial Sequence: Synthetic peptide
  c-term amidation

SEQ ID NO: 1655 - protein, 38 aa, Artificial Sequence; identical to SEQ ID NO: 1406
  Description of Artificial Sequence: Synthetic peptide
  c-term amidation

SEQ ID NO: 1656 - protein, 38 aa, Artificial Sequence; identical to SEQ ID NO: 1407
  Description of Artificial Sequence: Synthetic peptide
  c-term amidation

SEQ ID NO: 1657 - protein, 38 aa, Artificial Sequence; identical to SEQ ID NO: 1408
  Description of Artificial Sequence: Synthetic peptide
  c-term amidation

SEQ ID NO: 1658 - protein, 38 aa, Artificial Sequence; identical to SEQ ID NO: 1409
  Description of Artificial Sequence: Synthetic peptide
  c-term amidation

SEQ ID NO: 1659 - protein, 38 aa, Artificial Sequence; identical to SEQ ID NO: 1410
  Description of Artificial Sequence: Synthetic peptide
  c-term amidation

SEQ ID NO: 1660 - protein, 38 aa, Artificial Sequence; identical to SEQ ID NO: 1411
  Description of Artificial Sequence: Synthetic peptide
  c-term amidation

SEQ ID NO: 1661 - protein, 38 aa, Artificial Sequence; identical to SEQ ID NO: 1412
  Description of Artificial Sequence: Synthetic peptide
  c-term amidation

SEQ ID NO: 1662 - protein, 38 aa, Artificial Sequence; identical to SEQ ID NO: 1413
  Description of Artificial Sequence: Synthetic peptide
  c-term amidation

SEQ ID NO: 1663 - protein, 38 aa, Artificial Sequence; identical to SEQ ID NO: 1414
  Description of Artificial Sequence: Synthetic peptide
  c-term amidation

SEQ ID NO: 1664 - protein, 38 aa, Artificial Sequence; identical to SEQ ID NO: 1415
  Description of Artificial Sequence: Synthetic peptide
  c-term amidation

SEQ ID NO: 1665 - protein, 38 aa, Artificial Sequence; identical to SEQ ID NO: 1416
  Description of Artificial Sequence: Synthetic peptide
  c-term amidation

SEQ ID NO: 1666 - protein, 38 aa, Artificial Sequence; identical to SEQ ID NO: 25
  Description of Artificial Sequence: Synthetic peptide
  c-term amidation

SEQ ID NO: 1667 - protein, 38 aa, Artificial Sequence; identical to SEQ ID NO: 1418
  Description of Artificial Sequence: Synthetic peptide
  c-term amidation

SEQ ID NO: 1668 - protein, 38 aa, Artificial Sequence; identical to SEQ ID NO: 1419
  Description of Artificial Sequence: Synthetic peptide
  c-term amidation

SEQ ID NO: 1669 - protein, 38 aa, Artificial Sequence; identical to SEQ ID NO: 1420
  Description of Artificial Sequence: Synthetic peptide
  c-term amidation

SEQ ID NO: 1670 - protein, 38 aa, Artificial Sequence; identical to SEQ ID NO: 1421
  Description of Artificial Sequence: Synthetic peptide
  c-term amidation

SEQ ID NO: 1671 - protein, 38 aa, Artificial Sequence; identical to SEQ ID NO: 1422
  Description of Artificial Sequence: Synthetic peptide
  c-term amidation

SEQ ID NO: 1672 - protein, 38 aa, Artificial Sequence; identical to SEQ ID NO: 1423
  Description of Artificial Sequence: Synthetic peptide
  c-term amidation

SEQ ID NO: 1673 - protein, 38 aa, Artificial Sequence; identical to SEQ ID NO: 1424
  Description of Artificial Sequence: Synthetic peptide
  c-term amidation

SEQ ID NO: 1674 - protein, 38 aa, Artificial Sequence; identical to SEQ ID NO: 1425
  Description of Artificial Sequence: Synthetic peptide
  c-term amidation

SEQ ID NO: 1675 - protein, 38 aa, Artificial Sequence; identical to SEQ ID NO: 1426
  Description of Artificial Sequence: Synthetic peptide
  c-term amidation

SEQ ID NO: 1676 - protein, 38 aa, Artificial Sequence; identical to SEQ ID NO: 1427
  Description of Artificial Sequence: Synthetic peptide
  c-term amidation

SEQ ID NO: 1677 - protein, 38 aa, Artificial Sequence; identical to SEQ ID NO: 584
  Description of Artificial Sequence: Synthetic peptide
  c-term amidation

SEQ ID NO: 1678 - protein, 38 aa, Artificial Sequence; identical to SEQ ID NO: 1429
  Description of Artificial Sequence: Synthetic peptide
  c-term amidation

SEQ ID NO: 1679 - protein, 38 aa, Artificial Sequence; identical to SEQ ID NO: 1430
  Description of Artificial Sequence: Synthetic peptide
  c-term amidation

SEQ ID NO: 1680 - protein, 38 aa, Artificial Sequence; identical to SEQ ID NO: 1431
  Description of Artificial Sequence: Synthetic peptide
  c-term amidation

SEQ ID NO: 1681 - protein, 38 aa, Artificial Sequence; identical to SEQ ID NO: 1432
  Description of Artificial Sequence: Synthetic peptide
  c-term amidation

SEQ ID NO: 1682 - protein, 38 aa, Artificial Sequence; identical to SEQ ID NO: 1433
  Description of Artificial Sequence: Synthetic peptide
  c-term amidation

SEQ ID NO: 1683 - protein, 38 aa, Artificial Sequence; identical to SEQ ID NO: 1434
  Description of Artificial Sequence: Synthetic peptide
  c-term amidation

SEQ ID NO: 1684 - protein, 38 aa, Artificial Sequence; identical to SEQ ID NO: 1435
  Description of Artificial Sequence: Synthetic peptide
  c-term amidation

SEQ ID NO: 1685 - protein, 38 aa, Artificial Sequence; identical to SEQ ID NO: 1436
  Description of Artificial Sequence: Synthetic peptide
  c-term amidation

SEQ ID NO: 1686 - protein, 38 aa, Artificial Sequence; identical to SEQ ID NO: 1437
  Description of Artificial Sequence: Synthetic peptide
  c-term amidation

SEQ ID NO: 1687 - protein, 38 aa, Artificial Sequence; identical to SEQ ID NO: 1438
  Description of Artificial Sequence: Synthetic peptide
  c-term amidation

SEQ ID NO: 1688 - protein, 38 aa, Artificial Sequence; identical to SEQ ID NO: 1439
  Description of Artificial Sequence: Synthetic peptide
  c-term amidation

SEQ ID NO: 1689 - protein, 38 aa, Artificial Sequence; identical to SEQ ID NO: 1440
  Description of Artificial Sequence: Synthetic peptide
  c-term amidation

SEQ ID NO: 1690 - protein, 38 aa, Artificial Sequence; identical to SEQ ID NO: 1441
  Description of Artificial Sequence: Synthetic peptide
  c-term amidation

SEQ ID NO: 1691 - protein, 38 aa, Artificial Sequence; identical to SEQ ID NO: 1442
  Description of Artificial Sequence: Synthetic peptide
  c-term amidation

SEQ ID NO: 1692 - protein, 38 aa, Artificial Sequence; identical to SEQ ID NO: 1443
  Description of Artificial Sequence: Synthetic peptide
  c-term amidation

SEQ ID NO: 1693 - protein, 38 aa, Artificial Sequence; identical to SEQ ID NO: 1444
  Description of Artificial Sequence: Synthetic peptide
  c-term amidation

SEQ ID NO: 1694 - protein, 38 aa, Artificial Sequence; identical to SEQ ID NO: 1445
  Description of Artificial Sequence: Synthetic peptide
  c-term amidation

SEQ ID NO: 1695 - protein, 38 aa, Artificial Sequence; identical to SEQ ID NO: 1446
  Description of Artificial Sequence: Synthetic peptide
  c-term amidation

SEQ ID NO: 1696 - protein, 38 aa, Artificial Sequence; identical to SEQ ID NO: 1447
  Description of Artificial Sequence: Synthetic peptide
  c-term amidation

SEQ ID NO: 1697 - protein, 38 aa, Artificial Sequence; identical to SEQ ID NO: 1448
  Description of Artificial Sequence: Synthetic peptide
  c-term amidation

SEQ ID NO: 1698 - protein, 38 aa, Artificial Sequence; identical to SEQ ID NO: 1449
  Description of Artificial Sequence: Synthetic peptide
  c-term amidation

SEQ ID NO: 1699 - protein, 38 aa, Artificial Sequence; identical to SEQ ID NO: 1450
  Description of Artificial Sequence: Synthetic peptide
  c-term amidation

SEQ ID NO: 1700 - protein, 38 aa, Artificial Sequence; identical to SEQ ID NO: 1451
  Description of Artificial Sequence: Synthetic peptide
  c-term amidation

SEQ ID NO: 1701 - protein, 38 aa, Artificial Sequence; identical to SEQ ID NO: 1452
  Description of Artificial Sequence: Synthetic peptide
  c-term amidation

SEQ ID NO: 1702 - protein, 38 aa, Artificial Sequence; identical to SEQ ID NO: 1453
  Description of Artificial Sequence: Synthetic peptide
  c-term amidation

SEQ ID NO: 1703 - protein, 38 aa, Artificial Sequence; identical to SEQ ID NO: 1454
  Description of Artificial Sequence: Synthetic peptide
  c-term amidation

SEQ ID NO: 1704 - protein, 38 aa, Artificial Sequence; identical to SEQ ID NO: 1455
  Description of Artificial Sequence: Synthetic peptide
  c-term amidation

SEQ ID NO: 1705 - protein, 38 aa, Artificial Sequence; identical to SEQ ID NO: 1456
  Description of Artificial Sequence: Synthetic peptide
  c-term amidation

SEQ ID NO: 1706 - protein, 38 aa, Artificial Sequence; identical to SEQ ID NO: 1457
  Description of Artificial Sequence: Synthetic peptide
  c-term amidation

SEQ ID NO: 1707 - protein, 38 aa, Artificial Sequence; identical to SEQ ID NO: 1458
  Description of Artificial Sequence: Synthetic peptide
  c-term amidation

SEQ ID NO: 1708 - protein, 38 aa, Artificial Sequence; identical to SEQ ID NO: 1459
  Description of Artificial Sequence: Synthetic peptide
  c-term amidation

SEQ ID NO: 1709 - protein, 38 aa, Artificial Sequence; identical to SEQ ID NO: 1460
  Description of Artificial Sequence: Synthetic peptide
  c-term amidation

SEQ ID NO: 1710 - protein, 38 aa, Artificial Sequence; identical to SEQ ID NO: 1461
  Description of Artificial Sequence: Synthetic peptide
  c-term amidation

SEQ ID NO: 1711 - protein, 38 aa, Artificial Sequence; identical to SEQ ID NO: 1462
  Description of Artificial Sequence: Synthetic peptide
  c-term amidation

SEQ ID NO: 1712 - protein, 38 aa, Artificial Sequence; identical to SEQ ID NO: 1463
  Description of Artificial Sequence: Synthetic peptide
  c-term amidation

SEQ ID NO: 1713 - protein, 38 aa, Artificial Sequence; identical to SEQ ID NO: 1464
  Description of Artificial Sequence: Synthetic peptide
  c-term amidation

SEQ ID NO: 1714 - protein, 38 aa, Artificial Sequence; identical to SEQ ID NO: 1465
  Description of Artificial Sequence: Synthetic peptide
  c-term amidation

SEQ ID NO: 1715 - protein, 38 aa, Artificial Sequence; identical to SEQ ID NO: 1466
  Description of Artificial Sequence: Synthetic peptide
  c-term amidation

SEQ ID NO: 1716 - protein, 38 aa, Artificial Sequence; identical to SEQ ID NO: 1467
  Description of Artificial Sequence: Synthetic peptide
  c-term amidation

SEQ ID NO: 1717 - protein, 38 aa, Artificial Sequence; identical to SEQ ID NO: 1468
  Description of Artificial Sequence: Synthetic peptide
  c-term amidation

SEQ ID NO: 1718 - protein, 38 aa, Artificial Sequence; identical to SEQ ID NO: 1469
  Description of Artificial Sequence: Synthetic peptide
  c-term amidation

SEQ ID NO: 1719 - protein, 38 aa, Artificial Sequence; identical to SEQ ID NO: 1470
  Description of Artificial Sequence: Synthetic peptide
  c-term amidation

SEQ ID NO: 1720 - protein, 38 aa, Artificial Sequence; identical to SEQ ID NO: 1471
  Description of Artificial Sequence: Synthetic peptide
  c-term amidation

SEQ ID NO: 1721 - protein, 38 aa, Artificial Sequence; identical to SEQ ID NO: 1472
  Description of Artificial Sequence: Synthetic peptide
  c-term amidation

SEQ ID NO: 1722 - protein, 38 aa, Artificial Sequence; identical to SEQ ID NO: 1473
  Description of Artificial Sequence: Synthetic peptide
  c-term amidation

SEQ ID NO: 1723 - protein, 38 aa, Artificial Sequence; identical to SEQ ID NO: 1474
  Description of Artificial Sequence: Synthetic peptide
  c-term amidation

SEQ ID NO: 1724 - protein, 38 aa, Artificial Sequence; identical to SEQ ID NO: 1475
  Description of Artificial Sequence: Synthetic peptide
  c-term amidation

SEQ ID NO: 1725 - protein, 38 aa, Artificial Sequence; identical to SEQ ID NO: 1476
  Description of Artificial Sequence: Synthetic peptide
  c-term amidation

SEQ ID NO: 1726 - protein, 38 aa, Artificial Sequence; identical to SEQ ID NO: 1477
  Description of Artificial Sequence: Synthetic peptide
  c-term amidation

SEQ ID NO: 1727 - protein, 38 aa, Artificial Sequence; identical to SEQ ID NO: 1478
  Description of Artificial Sequence: Synthetic peptide
  c-term amidation

SEQ ID NO: 1728 - protein, 38 aa, Artificial Sequence; identical to SEQ ID NO: 1479
  Description of Artificial Sequence: Synthetic peptide
  c-term amidation

SEQ ID NO: 1729 - protein, 38 aa, Artificial Sequence; identical to SEQ ID NO: 1480
  Description of Artificial Sequence: Synthetic peptide
  c-term amidation

SEQ ID NO: 1730 - protein, 38 aa, Artificial Sequence; identical to SEQ ID NO: 1481
  Description of Artificial Sequence: Synthetic peptide
  c-term amidation

SEQ ID NO: 1731 - protein, 38 aa, Artificial Sequence; identical to SEQ ID NO: 1482
  Description of Artificial Sequence: Synthetic peptide
  c-term amidation

SEQ ID NO: 1732 - protein, 38 aa, Artificial Sequence; identical to SEQ ID NO: 1483
  Description of Artificial Sequence: Synthetic peptide
  c-term amidation

SEQ ID NO: 1733 - protein, 38 aa, Artificial Sequence; identical to SEQ ID NO: 1484
  Description of Artificial Sequence: Synthetic peptide
  c-term amidation

SEQ ID NO: 1734 - protein, 38 aa, Artificial Sequence; identical to SEQ ID NO: 1485
  Description of Artificial Sequence: Synthetic peptide
  c-term amidation

SEQ ID NO: 1735 - protein, 38 aa, Artificial Sequence; identical to SEQ ID NO: 1486
  Description of Artificial Sequence: Synthetic peptide
  c-term amidation

SEQ ID NO: 1736 - protein, 38 aa, Artificial Sequence; identical to SEQ ID NO: 1487
  Description of Artificial Sequence: Synthetic peptide
  c-term amidation

SEQ ID NO: 1737 - protein, 38 aa, Artificial Sequence; identical to SEQ ID NO: 1488
  Description of Artificial Sequence: Synthetic peptide
  c-term amidation

SEQ ID NO: 1738 - protein, 38 aa, Artificial Sequence; identical to SEQ ID NO: 1489
  Description of Artificial Sequence: Synthetic peptide
  c-term amidation

SEQ ID NO: 1739 - protein, 38 aa, Artificial Sequence; identical to SEQ ID NO: 1490
  Description of Artificial Sequence: Synthetic peptide
  c-term amidation

SEQ ID NO: 1740 - protein, 38 aa, Artificial Sequence; identical to SEQ ID NO: 1491
  Description of Artificial Sequence: Synthetic peptide
  c-term amidation

SEQ ID NO: 1741 - protein, 38 aa, Artificial Sequence; identical to SEQ ID NO: 1492
  Description of Artificial Sequence: Synthetic peptide
  c-term amidation

SEQ ID NO: 1742 - protein, 38 aa, Artificial Sequence; identical to SEQ ID NO: 1493
  Description of Artificial Sequence: Synthetic peptide
  MOD_RES (1)..(1): 1-Nal
  c-term amidation

SEQ ID NO: 1743 - protein, 38 aa, Artificial Sequence; identical to SEQ ID NO: 1494
  Description of Artificial Sequence: Synthetic peptide
  MOD_RES (2)..(2): 1-Nal
  c-term amidation

SEQ ID NO: 1744 - protein, 38 aa, Artificial Sequence; identical to SEQ ID NO: 1495
  Description of Artificial Sequence: Synthetic peptide
  MOD_RES (3)..(3): 1-Nal
  c-term amidation

SEQ ID NO: 1745 - protein, 38 aa, Artificial Sequence; identical to SEQ ID NO: 1496
  Description of Artificial Sequence: Synthetic peptide
  MOD_RES (4)..(4): 1-Nal
  c-term amidation

SEQ ID NO: 1746 - protein, 38 aa, Artificial Sequence; identical to SEQ ID NO: 1497
  Description of Artificial Sequence: Synthetic peptide
  MOD_RES (5)..(5): 1-Nal
  c-term amidation

SEQ ID NO: 1747 - protein, 38 aa, Artificial Sequence; identical to SEQ ID NO: 1498
  Description of Artificial Sequence: Synthetic peptide
  MOD_RES (6)..(6): 1-Nal
  c-term amidation

SEQ ID NO: 1748 - protein, 38 aa, Artificial Sequence; identical to SEQ ID NO: 1499
  Description of Artificial Sequence: Synthetic peptide
  MOD_RES (7)..(7): 1-Nal
  c-term amidation

SEQ ID NO: 1749 - protein, 38 aa, Artificial Sequence; identical to SEQ ID NO: 1500
  Description of Artificial Sequence: Synthetic peptide
  MOD_RES (9)..(9): 1-Nal
  c-term amidation

SEQ ID NO: 1750 - protein, 38 aa, Artificial Sequence; identical to SEQ ID NO: 1501
  Description of Artificial Sequence: Synthetic peptide
  MOD_RES (10)..(10): 1-Nal
  c-term amidation

SEQ ID NO: 1751 - protein, 38 aa, Artificial Sequence; identical to SEQ ID NO: 1502
  Description of Artificial Sequence: Synthetic peptide
  MOD_RES (11)..(11): 1-Nal
  c-term amidation

SEQ ID NO: 1752 - protein, 38 aa, Artificial Sequence; identical to SEQ ID NO: 1503
  Description of Artificial Sequence: Synthetic peptide
  MOD_RES (12)..(12): 1-Nal
  c-term amidation

SEQ ID NO: 1753 - protein, 38 aa, Artificial Sequence; identical to SEQ ID NO: 1504
  Description of Artificial Sequence: Synthetic peptide
  MOD_RES (13)..(13): 1-Nal
  c-term amidation

SEQ ID NO: 1754 - protein, 38 aa, Artificial Sequence; identical to SEQ ID NO: 1505
  Description of Artificial Sequence: Synthetic peptide
  MOD_RES (15)..(15): 1-Nal
  c-term amidation

SEQ ID NO: 1755 - protein, 38 aa, Artificial Sequence; identical to SEQ ID NO: 1506
  Description of Artificial Sequence: Synthetic peptide
  MOD_RES (16)..(16): 1-Nal
  c-term amidation

SEQ ID NO: 1756 - protein, 38 aa, Artificial Sequence; identical to SEQ ID NO: 1507
  Description of Artificial Sequence: Synthetic peptide
  MOD_RES (17)..(17): 1-Nal
  c-term amidation

SEQ ID NO: 1757 - protein, 38 aa, Artificial Sequence; identical to SEQ ID NO: 1508
  Description of Artificial Sequence: Synthetic peptide
  MOD_RES (19)..(19): 1-Nal
  c-term amidation

SEQ ID NO: 1758 - protein, 38 aa, Artificial Sequence; identical to SEQ ID NO: 1509
  Description of Artificial Sequence: Synthetic peptide
  MOD_RES (20)..(20): 1-Nal
  c-term amidation

SEQ ID NO: 1759 - protein, 38 aa, Artificial Sequence; identical to SEQ ID NO: 1510
  Description of Artificial Sequence: Synthetic peptide
  MOD_RES (21)..(21): 1-Nal
  c-term amidation

SEQ ID NO: 1760 - protein, 38 aa, Artificial Sequence; identical to SEQ ID NO: 1511
  Description of Artificial Sequence: Synthetic peptide
  MOD_RES (22)..(22): 1-Nal
  c-term amidation

SEQ ID NO: 1761 - protein, 38 aa, Artificial Sequence; identical to SEQ ID NO: 1512
  Description of Artificial Sequence: Synthetic peptide
  MOD_RES (23)..(23): 1-Nal
  c-term amidation

SEQ ID NO: 1762 - protein, 38 aa, Artificial Sequence; identical to SEQ ID NO: 1513
  Description of Artificial Sequence: Synthetic peptide
  MOD_RES (24)..(24): 1-Nal
  c-term amidation

SEQ ID NO: 1763 - protein, 38 aa, Artificial Sequence; identical to SEQ ID NO: 1514
  Description of Artificial Sequence: Synthetic peptide
  MOD_RES (25)..(25): 1-Nal
  c-term amidation

SEQ ID NO: 1764 - protein, 38 aa, Artificial Sequence; identical to SEQ ID NO: 1515
  Description of Artificial Sequence: Synthetic peptide
  MOD_RES (26)..(26): 1-Nal
  c-term amidation

SEQ ID NO: 1765 - protein, 38 aa, Artificial Sequence; identical to SEQ ID NO: 1516
  Description of Artificial Sequence: Synthetic peptide
  MOD_RES (27)..(27): 1-Nal
  c-term amidation

SEQ ID NO: 1766 - protein, 38 aa, Artificial Sequence; identical to SEQ ID NO: 1517
  Description of Artificial Sequence: Synthetic peptide
  MOD_RES (29)..(29): 1-Nal
  c-term amidation

SEQ ID NO: 1767 - protein, 38 aa, Artificial Sequence; identical to SEQ ID NO: 1518
  Description of Artificial Sequence: Synthetic peptide
  MOD_RES (30)..(30): 1-Nal
  c-term amidation

SEQ ID NO: 1768 - protein, 38 aa, Artificial Sequence; identical to SEQ ID NO: 1519
  Description of Artificial Sequence: Synthetic peptide
  MOD_RES (31)..(31): 1-Nal
  c-term amidation

SEQ ID NO: 1769 - protein, 38 aa, Artificial Sequence; identical to SEQ ID NO: 1520
  Description of Artificial Sequence: Synthetic peptide
  MOD_RES (32)..(32): 1-Nal
  c-term amidation

SEQ ID NO: 1770 - protein, 38 aa, Artificial Sequence; identical to SEQ ID NO: 1521
  Description of Artificial Sequence: Synthetic peptide
  MOD_RES (34)..(34): 1-Nal
  c-term amidation

SEQ ID NO: 1771 - protein, 38 aa, Artificial Sequence; identical to SEQ ID NO: 1522
  Description of Artificial Sequence: Synthetic peptide
  MOD_RES (36)..(36): 1-Nal
  c-term amidation

SEQ ID NO: 1772 - protein, 38 aa, Artificial Sequence; identical to SEQ ID NO: 1523
  Description of Artificial Sequence: Synthetic peptide
  MOD_RES (37)..(37): 1-Nal
  c-term amidation

SEQ ID NO: 1773 - protein, 38 aa, Artificial Sequence; identical to SEQ ID NO: 1524
  Description of Artificial Sequence: Synthetic peptide
  MOD_RES (38)..(38): 1-Nal
  c-term amidation

SEQ ID NO: 1774 - protein, 38 aa, Artificial Sequence; identical to SEQ ID NO: 1400
  Description of Artificial Sequence: Synthetic peptide
  n-term acetylation
  c-term amidation

SEQ ID NO: 1775 - protein, 38 aa, Artificial Sequence; identical to SEQ ID NO: 1401
  Description of Artificial Sequence: Synthetic peptide
  n-term acetylation
  c-term amidation

SEQ ID NO: 1776 - protein, 38 aa, Artificial Sequence; identical to SEQ ID NO: 1402
  Description of Artificial Sequence: Synthetic peptide
  n-term acetylation
  c-term amidation

SEQ ID NO: 1777 - protein, 38 aa, Artificial Sequence; identical to SEQ ID NO: 1403
  Description of Artificial Sequence: Synthetic peptide
  n-term acetylation
  c-term amidation

SEQ ID NO: 1778 - protein, 38 aa, Artificial Sequence; identical to SEQ ID NO: 1404
  Description of Artificial Sequence: Synthetic peptide
  n-term acetylation
  c-term amidation

SEQ ID NO: 1779 - protein, 38 aa, Artificial Sequence; identical to SEQ ID NO: 1405
  Description of Artificial Sequence: Synthetic peptide
  n-term acetylation
  c-term amidation

SEQ ID NO: 1780 - protein, 38 aa, Artificial Sequence; identical to SEQ ID NO: 1406
  Description of Artificial Sequence: Synthetic peptide
  n-term acetylation
  c-term amidation

SEQ ID NO: 1781 - protein, 38 aa, Artificial Sequence; identical to SEQ ID NO: 1407
  Description of Artificial Sequence: Synthetic peptide
  n-term acetylation
  c-term amidation

SEQ ID NO: 1782 - protein, 38 aa, Artificial Sequence; identical to SEQ ID NO: 1408
  Description of Artificial Sequence: Synthetic peptide
  n-term acetylation
  c-term amidation

SEQ ID NO: 1783 - protein, 38 aa, Artificial Sequence; identical to SEQ ID NO: 1409
  Description of Artificial Sequence: Synthetic peptide
  n-term acetylation
  c-term amidation

SEQ ID NO: 1784 - protein, 38 aa, Artificial Sequence; identical to SEQ ID NO: 1410
  Description of Artificial Sequence: Synthetic peptide
  n-term acetylation
  c-term amidation

SEQ ID NO: 1785 - protein, 38 aa, Artificial Sequence; identical to SEQ ID NO: 1411
  Description of Artificial Sequence: Synthetic peptide
  n-term acetylation
  c-term amidation

SEQ ID NO: 1786 - protein, 38 aa, Artificial Sequence; identical to SEQ ID NO: 1412
  Description of Artificial Sequence: Synthetic peptide
  n-term acetylation
  c-term amidation

SEQ ID NO: 1787 - protein, 38 aa, Artificial Sequence; identical to SEQ ID NO: 1413
  Description of Artificial Sequence: Synthetic peptide
  n-term acetylation
  c-term amidation

SEQ ID NO: 1788 - protein, 38 aa, Artificial Sequence; identical to SEQ ID NO: 1414
  Description of Artificial Sequence: Synthetic peptide
  n-term acetylation
  c-term amidation

SEQ ID NO: 1789 - protein, 38 aa, Artificial Sequence; identical to SEQ ID NO: 1415
  Description of Artificial Sequence: Synthetic peptide
  n-term acetylation
  c-term amidation

SEQ ID NO: 1790 - protein, 38 aa, Artificial Sequence; identical to SEQ ID NO: 1416
  Description of Artificial Sequence: Synthetic peptide
  n-term acetylation
  c-term amidation

SEQ ID NO: 1791 - protein, 38 aa, Artificial Sequence; identical to SEQ ID NO: 1418
  Description of Artificial Sequence: Synthetic peptide
  n-term acetylation
  c-term amidation

SEQ ID NO: 1792 - protein, 38 aa, Artificial Sequence; identical to SEQ ID NO: 1419
  Description of Artificial Sequence: Synthetic peptide
  n-term acetylation
  c-term amidation

SEQ ID NO: 1793 - protein, 38 aa, Artificial Sequence; identical to SEQ ID NO: 1420
  Description of Artificial Sequence: Synthetic peptide
  n-term acetylation
  c-term amidation

SEQ ID NO: 1794 - protein, 38 aa, Artificial Sequence; identical to SEQ ID NO: 1421
  Description of Artificial Sequence: Synthetic peptide
  n-term acetylation
  c-term amidation

SEQ ID NO: 1795 - protein, 38 aa, Artificial Sequence; identical to SEQ ID NO: 1422
  Description of Artificial Sequence: Synthetic peptide
  n-term acetylation
  c-term amidation

SEQ ID NO: 1796 - protein, 38 aa, Artificial Sequence; identical to SEQ ID NO: 1423
  Description of Artificial Sequence: Synthetic peptide
  n-term acetylation
  c-term amidation

SEQ ID NO: 1797 - protein, 38 aa, Artificial Sequence; identical to SEQ ID NO: 1424
  Description of Artificial Sequence: Synthetic peptide
  n-term acetylation
  c-term amidation

SEQ ID NO: 1798 - protein, 38 aa, Artificial Sequence; identical to SEQ ID NO: 1425
  Description of Artificial Sequence: Synthetic peptide
  n-term acetylation
  c-term amidation

SEQ ID NO: 1799 - protein, 38 aa, Artificial Sequence; identical to SEQ ID NO: 1426
  Description of Artificial Sequence: Synthetic peptide
  n-term acetylation
  c-term amidation

SEQ ID NO: 1800 - protein, 38 aa, Artificial Sequence; identical to SEQ ID NO: 1427
  Description of Artificial Sequence: Synthetic peptide
  n-term acetylation
  c-term amidation

SEQ ID NO: 1801 - protein, 38 aa, Artificial Sequence; identical to SEQ ID NO: 584
  Description of Artificial Sequence: Synthetic peptide
  n-term acetylation
  c-term amidation

SEQ ID NO: 1802 - protein, 38 aa, Artificial Sequence; identical to SEQ ID NO: 1429
  Description of Artificial Sequence: Synthetic peptide
  n-term acetylation
  c-term amidation

SEQ ID NO: 1803 - protein, 38 aa, Artificial Sequence; identical to SEQ ID NO: 1430
  Description of Artificial Sequence: Synthetic peptide
  n-term acetylation
  c-term amidation

SEQ ID NO: 1804 - protein, 38 aa, Artificial Sequence; identical to SEQ ID NO: 1431
  Description of Artificial Sequence: Synthetic peptide
  n-term acetylation
  c-term amidation

SEQ ID NO: 1805 - protein, 38 aa, Artificial Sequence; identical to SEQ ID NO: 1432
  Description of Artificial Sequence: Synthetic peptide
  n-term acetylation
  c-term amidation

SEQ ID NO: 1806 - protein, 38 aa, Artificial Sequence; identical to SEQ ID NO: 1433
  Description of Artificial Sequence: Synthetic peptide
  n-term acetylation
  c-term amidation

SEQ ID NO: 1807 - protein, 38 aa, Artificial Sequence; identical to SEQ ID NO: 1434
  Description of Artificial Sequence: Synthetic peptide
  n-term acetylation
  c-term amidation

SEQ ID NO: 1808 - protein, 38 aa, Artificial Sequence; identical to SEQ ID NO: 1435
  Description of Artificial Sequence: Synthetic peptide
  n-term acetylation
  c-term amidation

SEQ ID NO: 1809 - protein, 38 aa, Artificial Sequence; identical to SEQ ID NO: 1436
  Description of Artificial Sequence: Synthetic peptide
  n-term acetylation
  c-term amidation

SEQ ID NO: 1810 - protein, 38 aa, Artificial Sequence; identical to SEQ ID NO: 1437
  Description of Artificial Sequence: Synthetic peptide
  n-term acetylation
  c-term amidation

SEQ ID NO: 1811 - protein, 38 aa, Artificial Sequence; identical to SEQ ID NO: 1438
  Description of Artificial Sequence: Synthetic peptide
  n-term acetylation
  c-term amidation

SEQ ID NO: 1812 - protein, 38 aa, Artificial Sequence; identical to SEQ ID NO: 1439
  Description of Artificial Sequence: Synthetic peptide
  n-term acetylation
  c-term amidation

SEQ ID NO: 1813 - protein, 38 aa, Artificial Sequence; identical to SEQ ID NO: 1440
  Description of Artificial Sequence: Synthetic peptide
  n-term acetylation
  c-term amidation

SEQ ID NO: 1814 - protein, 38 aa, Artificial Sequence; identical to SEQ ID NO: 1441
  Description of Artificial Sequence: Synthetic peptide
  n-term acetylation
  c-term amidation

SEQ ID NO: 1815 - protein, 38 aa, Artificial Sequence; identical to SEQ ID NO: 1442
  Description of Artificial Sequence: Synthetic peptide
  n-term acetylation
  c-term amidation

SEQ ID NO: 1816 - protein, 38 aa, Artificial Sequence; identical to SEQ ID NO: 1443
  Description of Artificial Sequence: Synthetic peptide
  n-term acetylation
  c-term amidation

SEQ ID NO: 1817 - protein, 38 aa, Artificial Sequence; identical to SEQ ID NO: 1444
  Description of Artificial Sequence: Synthetic peptide
  n-term acetylation
  c-term amidation

SEQ ID NO: 1818 - protein, 38 aa, Artificial Sequence; identical to SEQ ID NO: 1445
  Description of Artificial Sequence: Synthetic peptide
  n-term acetylation
  c-term amidation

SEQ ID NO: 1819 - protein, 38 aa, Artificial Sequence; identical to SEQ ID NO: 1446
  Description of Artificial Sequence: Synthetic peptide
  n-term acetylation
  c-term amidation

SEQ ID NO: 1820 - protein, 38 aa, Artificial Sequence; identical to SEQ ID NO: 1447
  Description of Artificial Sequence: Synthetic peptide
  n-term acetylation
  c-term amidation

SEQ ID NO: 1821 - protein, 38 aa, Artificial Sequence; identical to SEQ ID NO: 1448
  Description of Artificial Sequence: Synthetic peptide
  n-term acetylation
  c-term amidation

SEQ ID NO: 1822 - protein, 38 aa, Artificial Sequence; identical to SEQ ID NO: 1449
  Description of Artificial Sequence: Synthetic peptide
  n-term acetylation
  c-term amidation

SEQ ID NO: 1823 - protein, 38 aa, Artificial Sequence; identical to SEQ ID NO: 1450
  Description of Artificial Sequence: Synthetic peptide
  n-term acetylation
  c-term amidation

SEQ ID NO: 1824 - protein, 38 aa, Artificial Sequence; identical to SEQ ID NO: 1451
  Description of Artificial Sequence: Synthetic peptide
  n-term acetylation
  c-term amidation

SEQ ID NO: 1825 - protein, 38 aa, Artificial Sequence; identical to SEQ ID NO: 1452
  Description of Artificial Sequence: Synthetic peptide
  n-term acetylation
  c-term amidation

SEQ ID NO: 1826 - protein, 38 aa, Artificial Sequence; identical to SEQ ID NO: 1453
  Description of Artificial Sequence: Synthetic peptide
  n-term acetylation
  c-term amidation

SEQ ID NO: 1827 - protein, 38 aa, Artificial Sequence; identical to SEQ ID NO: 1454
  Description of Artificial Sequence: Synthetic peptide
  n-term acetylation
  c-term amidation

SEQ ID NO: 1828 - protein, 38 aa, Artificial Sequence; identical to SEQ ID NO: 1455
  Description of Artificial Sequence: Synthetic peptide
  n-term acetylation
  c-term amidation

SEQ ID NO: 1829 - protein, 38 aa, Artificial Sequence; identical to SEQ ID NO: 1456
  Description of Artificial Sequence: Synthetic peptide
  n-term acetylation
  c-term amidation

SEQ ID NO: 1830 - protein, 38 aa, Artificial Sequence; identical to SEQ ID NO: 1457
  Description of Artificial Sequence: Synthetic peptide
  n-term acetylation
  c-term amidation

SEQ ID NO: 1831 - protein, 38 aa, Artificial Sequence; identical to SEQ ID NO: 1458
  Description of Artificial Sequence: Synthetic peptide
  n-term acetylation
  c-term amidation

SEQ ID NO: 1832 - protein, 38 aa, Artificial Sequence; identical to SEQ ID NO: 1459
  Description of Artificial Sequence: Synthetic peptide
  n-term acetylation
  c-term amidation

SEQ ID NO: 1833 - protein, 38 aa, Artificial Sequence; identical to SEQ ID NO: 1460
  Description of Artificial Sequence: Synthetic peptide
  n-term acetylation
  c-term amidation

SEQ ID NO: 1834 - protein, 38 aa, Artificial Sequence; identical to SEQ ID NO: 1461
  Description of Artificial Sequence: Synthetic peptide
  n-term acetylation
  c-term amidation

SEQ ID NO: 1835 - protein, 38 aa, Artificial Sequence; identical to SEQ ID NO: 1462
  Description of Artificial Sequence: Synthetic peptide
  n-term acetylation
  c-term amidation

SEQ ID NO: 1836 - protein, 38 aa, Artificial Sequence; identical to SEQ ID NO: 1463
  Description of Artificial Sequence: Synthetic peptide
  n-term acetylation
  c-term amidation

SEQ ID NO: 1837 - protein, 38 aa, Artificial Sequence; identical to SEQ ID NO: 1464
  Description of Artificial Sequence: Synthetic peptide
  n-term acetylation
  c-term amidation

SEQ ID NO: 1838 - protein, 38 aa, Artificial Sequence; identical to SEQ ID NO: 1465
  Description of Artificial Sequence: Synthetic peptide
  n-term acetylation
  c-term amidation

SEQ ID NO: 1839 - protein, 38 aa, Artificial Sequence; identical to SEQ ID NO: 1466
  Description of Artificial Sequence: Synthetic peptide
  n-term acetylation
  c-term amidation

SEQ ID NO: 1840 - protein, 38 aa, Artificial Sequence; identical to SEQ ID NO: 1467
  Description of Artificial Sequence: Synthetic peptide
  n-term acetylation
  c-term amidation

SEQ ID NO: 1841 - protein, 38 aa, Artificial Sequence; identical to SEQ ID NO: 1468
  Description of Artificial Sequence: Synthetic peptide
  n-term acetylation
  c-term amidation

SEQ ID NO: 1842 - protein, 38 aa, Artificial Sequence; identical to SEQ ID NO: 1469
  Description of Artificial Sequence: Synthetic peptide
  n-term acetylation
  c-term amidation

SEQ ID NO: 1843 - protein, 38 aa, Artificial Sequence; identical to SEQ ID NO: 1470
  Description of Artificial Sequence: Synthetic peptide
  n-term acetylation
  c-term amidation

SEQ ID NO: 1844 - protein, 38 aa, Artificial Sequence; identical to SEQ ID NO: 1471
  Description of Artificial Sequence: Synthetic peptide
  n-term acetylation
  c-term amidation

SEQ ID NO: 1845 - protein, 38 aa, Artificial Sequence; identical to SEQ ID NO: 1472
  Description of Artificial Sequence: Synthetic peptide
  n-term acetylation
  c-term amidation

SEQ ID NO: 1846 - protein, 38 aa, Artificial Sequence; identical to SEQ ID NO: 1473
  Description of Artificial Sequence: Synthetic peptide
  n-term acetylation
  c-term amidation

SEQ ID NO: 1847 - protein, 38 aa, Artificial Sequence; identical to SEQ ID NO: 1474
  Description of Artificial Sequence: Synthetic peptide
  n-term acetylation
  c-term amidation

SEQ ID NO: 1848 - protein, 38 aa, Artificial Sequence; identical to SEQ ID NO: 1475
  Description of Artificial Sequence: Synthetic peptide
  n-term acetylation
  c-term amidation

SEQ ID NO: 1849 - protein, 38 aa, Artificial Sequence; identical to SEQ ID NO: 1476
  Description of Artificial Sequence: Synthetic peptide
  n-term acetylation
  c-term amidation

SEQ ID NO: 1850 - protein, 38 aa, Artificial Sequence; identical to SEQ ID NO: 1477
  Description of Artificial Sequence: Synthetic peptide
  n-term acetylation
  c-term amidation

SEQ ID NO: 1851 - protein, 38 aa, Artificial Sequence; identical to SEQ ID NO: 1478
  Description of Artificial Sequence: Synthetic peptide
  n-term acetylation
  c-term amidation

SEQ ID NO: 1852 - protein, 38 aa, Artificial Sequence; identical to SEQ ID NO: 1479
  Description of Artificial Sequence: Synthetic peptide
  n-term acetylation
  c-term amidation

SEQ ID NO: 1853 - protein, 38 aa, Artificial Sequence; identical to SEQ ID NO: 1480
  Description of Artificial Sequence: Synthetic peptide
  n-term acetylation
  c-term amidation

SEQ ID NO: 1854 - protein, 38 aa, Artificial Sequence; identical to SEQ ID NO: 1481
  Description of Artificial Sequence: Synthetic peptide
  n-term acetylation
  c-term amidation

SEQ ID NO: 1855 - protein, 38 aa, Artificial Sequence; identical to SEQ ID NO: 1482
  Description of Artificial Sequence: Synthetic peptide
  n-term acetylation
  c-term amidation

SEQ ID NO: 1856 - protein, 38 aa, Artificial Sequence; identical to SEQ ID NO: 1483
  Description of Artificial Sequence: Synthetic peptide
  n-term acetylation
  c-term amidation

SEQ ID NO: 1857 - protein, 38 aa, Artificial Sequence; identical to SEQ ID NO: 1484
  Description of Artificial Sequence: Synthetic peptide
  n-term acetylation
  c-term amidation

SEQ ID NO: 1858 - protein, 38 aa, Artificial Sequence; identical to SEQ ID NO: 1485
  Description of Artificial Sequence: Synthetic peptide
  n-term acetylation
  c-term amidation

SEQ ID NO: 1859 - protein, 38 aa, Artificial Sequence; identical to SEQ ID NO: 1486
  Description of Artificial Sequence: Synthetic peptide
  n-term acetylation
  c-term amidation

SEQ ID NO: 1860 - protein, 38 aa, Artificial Sequence; identical to SEQ ID NO: 1487
  Description of Artificial Sequence: Synthetic peptide
  n-term acetylation
  c-term amidation

SEQ ID NO: 1861 - protein, 38 aa, Artificial Sequence; identical to SEQ ID NO: 1488
  Description of Artificial Sequence: Synthetic peptide
  n-term acetylation
  c-term amidation

SEQ ID NO: 1862 - protein, 38 aa, Artificial Sequence; identical to SEQ ID NO: 1489
  Description of Artificial Sequence: Synthetic peptide
  n-term acetylation
  c-term amidation

SEQ ID NO: 1863 - protein, 38 aa, Artificial Sequence; identical to SEQ ID NO: 1490
  Description of Artificial Sequence: Synthetic peptide
  n-term acetylation
  c-term amidation

SEQ ID NO: 1864 - protein, 38 aa, Artificial Sequence; identical to SEQ ID NO: 1491
  Description of Artificial Sequence: Synthetic peptide
  n-term acetylation
  c-term amidation

SEQ ID NO: 1865 - protein, 38 aa, Artificial Sequence; identical to SEQ ID NO: 1492
  Description of Artificial Sequence: Synthetic peptide
  n-term acetylation
  c-term amidation

SEQ ID NO: 1866 - protein, 38 aa, Artificial Sequence; identical to SEQ ID NO: 1493
  Description of Artificial Sequence: Synthetic peptide
  MOD_RES (1)..(1): 1-Nal
  n-term acetylation
  c-term amidation

SEQ ID NO: 1867 - protein, 38 aa, Artificial Sequence; identical to SEQ ID NO: 1494
  Description of Artificial Sequence: Synthetic peptide
  MOD_RES (2)..(2): 1-Nal
  n-term acetylation
  c-term amidation

SEQ ID NO: 1868 - protein, 38 aa, Artificial Sequence; identical to SEQ ID NO: 1495
  Description of Artificial Sequence: Synthetic peptide
  MOD_RES (3)..(3): 1-Nal
  n-term acetylation
  c-term amidation

SEQ ID NO: 1869 - protein, 38 aa, Artificial Sequence; identical to SEQ ID NO: 1496
  Description of Artificial Sequence: Synthetic peptide
  MOD_RES (4)..(4): 1-Nal
  n-term acetylation
  c-term amidation

SEQ ID NO: 1870 - protein, 38 aa, Artificial Sequence; identical to SEQ ID NO: 1497
  Description of Artificial Sequence: Synthetic peptide
  MOD_RES (5)..(5): 1-Nal
  n-term acetylation
  c-term amidation

SEQ ID NO: 1871 - protein, 38 aa, Artificial Sequence; identical to SEQ ID NO: 1498
  Description of Artificial Sequence: Synthetic peptide
  MOD_RES (6)..(6): 1-Nal
  n-term acetylation
  c-term amidation

SEQ ID NO: 1872 - protein, 38 aa, Artificial Sequence; identical to SEQ ID NO: 1499
  Description of Artificial Sequence: Synthetic peptide
  MOD_RES (7)..(7): 1-Nal
  n-term acetylation
  c-term amidation

SEQ ID NO: 1873 - protein, 38 aa, Artificial Sequence; identical to SEQ ID NO: 1500
  Description of Artificial Sequence: Synthetic peptide
  MOD_RES (9)..(9): 1-Nal
  n-term acetylation
  c-term amidation

SEQ ID NO: 1874 - protein, 38 aa, Artificial Sequence; identical to SEQ ID NO: 1501
  Description of Artificial Sequence: Synthetic peptide
  MOD_RES (10)..(10): 1-Nal
  n-term acetylation
  c-term amidation

SEQ ID NO: 1875 - protein, 38 aa, Artificial Sequence; identical to SEQ ID NO: 1502
  Description of Artificial Sequence: Synthetic peptide
  MOD_RES (11)..(11): 1-Nal
  n-term acetylation
  c-term amidation

SEQ ID NO: 1876 - protein, 38 aa, Artificial Sequence; identical to SEQ ID NO: 1503
  Description of Artificial Sequence: Synthetic peptide
  MOD_RES (12)..(12): 1-Nal
  n-term acetylation
  c-term amidation

SEQ ID NO: 1877 - protein, 38 aa, Artificial Sequence; identical to SEQ ID NO: 1504
  Description of Artificial Sequence: Synthetic peptide
  MOD_RES (13)..(13): 1-Nal
  n-term acetylation
  c-term amidation

SEQ ID NO: 1878 - protein, 38 aa, Artificial Sequence; identical to SEQ ID NO: 1505
  Description of Artificial Sequence: Synthetic peptide
  MOD_RES (15)..(15): 1-Nal
  n-term acetylation
  c-term amidation

SEQ ID NO: 1879 - protein, 38 aa, Artificial Sequence; identical to SEQ ID NO: 1506
  Description of Artificial Sequence: Synthetic peptide
  MOD_RES (16)..(16): 1-Nal
  n-term acetylation
  c-term amidation

SEQ ID NO: 1880 - protein, 38 aa, Artificial Sequence; identical to SEQ ID NO: 1507
  Description of Artificial Sequence: Synthetic peptide
  MOD_RES (17)..(17): 1-Nal
  n-term acetylation
  c-term amidation

SEQ ID NO: 1881 - protein, 38 aa, Artificial Sequence; identical to SEQ ID NO: 1508
  Description of Artificial Sequence: Synthetic peptide
  MOD_RES (19)..(19): 1-Nal
  n-term acetylation
  c-term amidation

SEQ ID NO: 1882 - protein, 38 aa, Artificial Sequence; identical to SEQ ID NO: 1509
  Description of Artificial Sequence: Synthetic peptide
  MOD_RES (20)..(20): 1-Nal
  n-term acetylation
  c-term amidation

SEQ ID NO: 1883 - protein, 38 aa, Artificial Sequence; identical to SEQ ID NO: 1510
  Description of Artificial Sequence: Synthetic peptide
  MOD_RES (21)..(21): 1-Nal
  n-term acetylation
  c-term amidation

SEQ ID NO: 1884 - protein, 38 aa, Artificial Sequence; identical to SEQ ID NO: 1511
  Description of Artificial Sequence: Synthetic peptide
  MOD_RES (22)..(22): 1-Nal
  n-term acetylation
  c-term amidation

SEQ ID NO: 1885 - protein, 38 aa, Artificial Sequence; identical to SEQ ID NO: 1512
  Description of Artificial Sequence: Synthetic peptide
  MOD_RES (23)..(23): 1-Nal
  n-term acetylation
  c-term amidation

SEQ ID NO: 1886 - protein, 38 aa, Artificial Sequence; identical to SEQ ID NO: 1513
  Description of Artificial Sequence: Synthetic peptide
  MOD_RES (24)..(24): 1-Nal
  n-term acetylation
  c-term amidation

SEQ ID NO: 1887 - protein, 38 aa, Artificial Sequence; identical to SEQ ID NO: 1514
  Description of Artificial Sequence: Synthetic peptide
  MOD_RES (25)..(25): 1-Nal
  n-term acetylation
  c-term amidation

SEQ ID NO: 1888 - protein, 38 aa, Artificial Sequence; identical to SEQ ID NO: 1515
  Description of Artificial Sequence: Synthetic peptide
  MOD_RES (26)..(26): 1-Nal
  n-term acetylation
  c-term amidation

SEQ ID NO: 1889 - protein, 38 aa, Artificial Sequence; identical to SEQ ID NO: 1516
  Description of Artificial Sequence: Synthetic peptide
  MOD_RES (27)..(27): 1-Nal
  n-term acetylation
  c-term amidation

SEQ ID NO: 1890 - protein, 38 aa, Artificial Sequence; identical to SEQ ID NO: 1517
  Description of Artificial Sequence: Synthetic peptide
  MOD_RES (29)..(29): 1-Nal
  n-term acetylation
  c-term amidation

SEQ ID NO: 1891 - protein, 38 aa, Artificial Sequence; identical to SEQ ID NO: 1518
  Description of Artificial Sequence: Synthetic peptide
  MOD_RES (30)..(30): 1-Nal
  n-term acetylation
  c-term amidation

SEQ ID NO: 1892 - protein, 38 aa, Artificial Sequence; identical to SEQ ID NO: 1519
  Description of Artificial Sequence: Synthetic peptide
  MOD_RES (31)..(31): 1-Nal
  n-term acetylation
  c-term amidation

SEQ ID NO: 1893 - protein, 38 aa, Artificial Sequence; identical to SEQ ID NO: 1520
  Description of Artificial Sequence: Synthetic peptide
  MOD_RES (32)..(32): 1-Nal
  n-term acetylation
  c-term amidation

SEQ ID NO: 1894 - protein, 38 aa, Artificial Sequence; identical to SEQ ID NO: 1521
  Description of Artificial Sequence: Synthetic peptide
  MOD_RES (34)..(34): 1-Nal
  n-term acetylation
  c-term amidation

SEQ ID NO: 1895 - protein, 38 aa, Artificial Sequence; identical to SEQ ID NO: 1522
  Description of Artificial Sequence: Synthetic peptide
  MOD_RES (36)..(36): 1-Nal
  n-term acetylation
  c-term amidation

SEQ ID NO: 1896 - protein, 38 aa, Artificial Sequence; identical to SEQ ID NO: 1523
  Description of Artificial Sequence: Synthetic peptide
  MOD_RES (37)..(37): 1-Nal
  n-term acetylation
  c-term amidation

SEQ ID NO: 1897 - protein, 38 aa, Artificial Sequence; identical to SEQ ID NO: 1524
  Description of Artificial Sequence: Synthetic peptide
  MOD_RES (38)..(38): 1-Nal
  n-term acetylation
  c-term amidation

SEQ ID NO: 1898 - protein, 38 aa, Artificial Sequence; identical to SEQ ID NO: 1410
  Description of Artificial Sequence: Synthetic peptide

SEQ ID NO: 1899 - protein, 38 aa, Artificial Sequence
  Description of Artificial Sequence: Synthetic peptide
GVIINVSCKISAQCLEPCKKAGMRFGKCMNGKCHCTPK

SEQ ID NO: 1900 - protein, 38 aa, Artificial Sequence
  Description of Artificial Sequence: Synthetic peptide
GVIINVKCKISAQCLKPCKKAGMRFGKCMNGKCHCTPK

SEQ ID NO: 1901 - protein, 38 aa, Artificial Sequence
  Description of Artificial Sequence: Synthetic peptide
GVIINVKCKISAQCLEPCKDAGMRFGKCMNGKCHCTPK

SEQ ID NO: 1902 - protein, 38 aa, Artificial Sequence; identical to SEQ ID NO: 1392
  Description of Artificial Sequence: Synthetic peptide

SEQ ID NO: 1903 - protein, 38 aa, Artificial Sequence
  Description of Artificial Sequence: Synthetic peptide
GVIINVSCKISAQCLKPCKDAGMRFGKCMNGKCHCTPK

SEQ ID NO: 1904 - protein, 38 aa, Artificial Sequence; identical to SEQ ID NO: 297
  Description of Artificial Sequence: Synthetic peptide

SEQ ID NO: 1905 - protein, 38 aa, Artificial Sequence
  Description of Artificial Sequence: Synthetic peptide
GVIINVKCKISAQCLKPCKDAGMRFGKCMNGKCHCYPK

SEQ ID NO: 1906 - protein, 38 aa, Artificial Sequence; identical to SEQ ID NO: 297
  Description of Artificial Sequence: Synthetic peptide
  n-term acetylation

SEQ ID NO: 1907 - protein, 38 aa, Artificial Sequence; identical to SEQ ID NO: 297
  Description of Artificial Sequence: Synthetic peptide
  c-term amidation

SEQ ID NO: 1908 - protein, 38 aa, Artificial Sequence; identical to SEQ ID NO: 297
  Description of Artificial Sequence: Synthetic peptide
  n-term acetylation
  c-term amidation

SEQ ID NO: 1909 - protein, 38 aa, Artificial Sequence; identical to SEQ ID NO: 1905
  Description of Artificial Sequence: Synthetic peptide
  c-term amidation

SEQ ID NO: 1910 - protein, 38 aa, Artificial Sequence; identical to SEQ ID NO: 1905
  Description of Artificial Sequence: Synthetic peptide
  n-term acetylation

SEQ ID NO: 1911 - protein, 38 aa, Artificial Sequence; identical to SEQ ID NO: 1905
  Description of Artificial Sequence: Synthetic peptide
  n-term acetylation
  c-term amidation

SEQ ID NO: 1912 - protein, 38 aa, Artificial Sequence; identical to SEQ ID NO: 1900
  Description of Artificial Sequence: Synthetic peptide
  c-term amidation

SEQ ID NO: 1913 - protein, 38 aa, Artificial Sequence; identical to SEQ ID NO: 1900
  Description of Artificial Sequence: Synthetic peptide
  n-term acetylation

SEQ ID NO: 1914 - protein, 38 aa, Artificial Sequence; identical to SEQ ID NO: 1900
  Description of Artificial Sequence: Synthetic peptide
  n-term acetylation
  c-term amidation

SEQ ID NO: 1915 - protein, 38 aa, Artificial Sequence; identical to SEQ ID NO: 1901
  Description of Artificial Sequence: Synthetic peptide
  n-term acetylation

SEQ ID NO: 1916 - protein, 38 aa, Artificial Sequence; identical to SEQ ID NO: 1901
  Description of Artificial Sequence: Synthetic peptide
  c-term amidation

SEQ ID NO: 1917 - protein, 38 aa, Artificial Sequence; identical to SEQ ID NO: 1901
  Description of Artificial Sequence: Synthetic peptide
  n-term acetylation
  c-term amidation

SEQ ID NO: 1918 - protein, 38 aa, Artificial Sequence; identical to SEQ ID NO: 1410
  Description of Artificial Sequence: Synthetic peptide
  c-term amidation

SEQ ID NO: 1919 - protein, 38 aa, Artificial Sequence; identical to SEQ ID NO: 1410
  Description of Artificial Sequence: Synthetic peptide
  n-term acetylation

SEQ ID NO: 1920 - protein, 38 aa, Artificial Sequence; identical to SEQ ID NO: 1410
  Description of Artificial Sequence: Synthetic peptide
  n-term acetylation
  c-term amidation

SEQ ID NO: 1921 - protein, 38 aa, Artificial Sequence; identical to SEQ ID NO: 1392
  Description of Artificial Sequence: Synthetic peptide
  c-term amidation

SEQ ID NO: 1922 - protein, 38 aa, Artificial Sequence; identical to SEQ ID NO: 1392
  Description of Artificial Sequence: Synthetic peptide
  n-term acetylation

SEQ ID NO: 1923 - protein, 38 aa, Artificial Sequence; identical to SEQ ID NO: 1392
  Description of Artificial Sequence: Synthetic peptide
  n-term acetylation
  c-term amidation

SEQ ID NO: 1924 - protein, 37 aa, Artificial Sequence
  Description of Artificial Sequence: Synthetic peptide
VIINVKCKISAQCLEPCKKAGMRFGKCMNGKCHCTPK

SEQ ID NO: 1925 - protein, 37 aa, Artificial Sequence; identical to SEQ ID NO: 1924
  Description of Artificial Sequence: Synthetic peptide
  n-term acetylation

SEQ ID NO: 1926 - protein, 37 aa, Artificial Sequence; identical to SEQ ID NO: 1924
  Description of Artificial Sequence: Synthetic peptide
  c-term amidation

SEQ ID NO: 1927 - protein, 37 aa, Artificial Sequence; identical to SEQ ID NO: 1924
  Description of Artificial Sequence: Synthetic peptide
  n-term acetylation
  c-term amidation

SEQ ID NO: 1928 - protein, 38 aa, Artificial Sequence
  Description of Artificial Sequence: Synthetic peptide
GVIINVKCKISAQCLEPCKKAGMRFGKCMNGKCACTPK

SEQ ID NO: 1929 - protein, 38 aa, Artificial Sequence; identical to SEQ ID NO: 1928
  Description of Artificial Sequence: Synthetic peptide
  n-term acetylation

SEQ ID NO: 1930 - protein, 38 aa, Artificial Sequence; identical to SEQ ID NO: 1928
  Description of Artificial Sequence: Synthetic peptide
  c-term amidation

SEQ ID NO: 1931 - protein, 38 aa, Artificial Sequence; identical to SEQ ID NO: 1928
  Description of Artificial Sequence: Synthetic peptide
  n-term acetylation
  c-term amidation

SEQ ID NO: 1932 - protein, 37 aa, Artificial Sequence
  Description of Artificial Sequence: Synthetic peptide
VIINVKCKISAQCLKPCKDAGMRFGKCMNGKCHCTPK

SEQ ID NO: 1933 - protein, 37 aa, Artificial Sequence; identical to SEQ ID NO: 1932
  Description of Artificial Sequence: Synthetic peptide
  n-term acetylation

SEQ ID NO: 1934 - protein, 37 aa, Artificial Sequence; identical to SEQ ID NO: 1932
  Description of Artificial Sequence: Synthetic peptide
  c-term amidation

SEQ ID NO: 1935 - protein, 37 aa, Artificial Sequence; identical to SEQ ID NO: 1932
  Description of Artificial Sequence: Synthetic peptide
  n-term acetylation
  c-term amidation

SEQ ID NO: 1936 - protein, 34 aa, Artificial Sequence
  Description of Artificial Sequence: Synthetic peptide
NVKCKISAQCLKPCKDAGMRFGKCMNGKCHCTPK

SEQ ID NO: 1937 - protein, 34 aa, Artificial Sequence; identical to SEQ ID NO: 1936
  Description of Artificial Sequence: Synthetic peptide
  n-term acetylation

SEQ ID NO: 1938 - protein, 34 aa, Artificial Sequence; identical to SEQ ID NO: 1936
  Description of Artificial Sequence: Synthetic peptide
  c-term amidation

SEQ ID NO: 1939 - protein, 34 aa, Artificial Sequence; identical to SEQ ID NO: 1936
  Description of Artificial Sequence: Synthetic peptide
  n-term acetylation
  c-term amidation

SEQ ID NO: 1940 - protein, 32 aa, Artificial Sequence
  Description of Artificial Sequence: Synthetic peptide
KCKISAQCLKPCKDAGMRFGKCMNGKCHCTPK

SEQ ID NO: 1941 - protein, 32 aa, Artificial Sequence; identical to SEQ ID NO: 1940
  Description of Artificial Sequence: Synthetic peptide
  n-term acetylation

SEQ ID NO: 1942 - protein, 32 aa, Artificial Sequence; identical to SEQ ID NO: 1940
  Description of Artificial Sequence: Synthetic peptide
  c-term amidation

SEQ ID NO: 1943 - protein, 32 aa, Artificial Sequence; identical to SEQ ID NO: 1940
  Description of Artificial Sequence: Synthetic peptide
  n-term acetylation
  c-term amidation

SEQ ID NO: 1944 - protein, 31 aa, Artificial Sequence
  Description of Artificial Sequence: Synthetic peptide
CKISAQCLKPCKDAGMRFGKCMNGKCHCTPK

SEQ ID NO: 1945 - protein, 31 aa, Artificial Sequence; identical to SEQ ID NO: 1944
  Description of Artificial Sequence: Synthetic peptide
  n-term acetylation

SEQ ID NO: 1946 - protein, 31 aa, Artificial Sequence; identical to SEQ ID NO: 1944
  Description of Artificial Sequence: Synthetic peptide
  c-term amidation

SEQ ID NO: 1947 - protein, 31 aa, Artificial Sequence; identical to SEQ ID NO: 1944
  Description of Artificial Sequence: Synthetic peptide
  n-term acetylation
  c-term amidation

SEQ ID NO: 1948 - protein, 38 aa, Artificial Sequence
  Description of Artificial Sequence: Synthetic peptide
GVIINVKCKISAQCLKPCKDAGMRNGKCMNGKCHCTPK

SEQ ID NO: 1949 - protein, 38 aa, Artificial Sequence; identical to SEQ ID NO: 1948
  Description of Artificial Sequence: Synthetic peptide
  c-term amidation

SEQ ID NO: 1950 - protein, 38 aa, Artificial Sequence; identical to SEQ ID NO: 1948
  Description of Artificial Sequence: Synthetic peptide
  n-term acetylation

SEQ ID NO: 1951 - protein, 38 aa, Artificial Sequence; identical to SEQ ID NO: 1948
  Description of Artificial Sequence: Synthetic peptide
  n-term acetylation
  c-term amidation

SEQ ID NO: 1952 - protein, 38 aa, Artificial Sequence
  Description of Artificial Sequence: Synthetic peptide
GVIINVKCKISAQCLKPCKDAGMRFGKCMNRKCHCTPK

SEQ ID NO: 1953 - protein, 38 aa, Artificial Sequence; identical to SEQ ID NO: 1952
  Description of Artificial Sequence: Synthetic peptide
  c-term amidation

SEQ ID NO: 1954 - protein, 38 aa, Artificial Sequence; identical to SEQ ID NO: 1952
  Description of Artificial Sequence: Synthetic peptide
  n-term acetylation

SEQ ID NO: 1955 - protein, 38 aa, Artificial Sequence; identical to SEQ ID NO: 1952
  Description of Artificial Sequence: Synthetic peptide
  n-term acetylation
  c-term amidation

SEQ ID NO: 1956 - protein, 38 aa, Artificial Sequence; identical to SEQ ID NO: 612
  Description of Artificial Sequence: Synthetic peptide

SEQ ID NO: 1957 - protein, 38 aa, Artificial Sequence; identical to SEQ ID NO: 612
  Description of Artificial Sequence: Synthetic peptide
  n-term acetylation

SEQ ID NO: 1958 - protein, 38 aa, Artificial Sequence; identical to SEQ ID NO: 612
  Description of Artificial Sequence: Synthetic peptide
  c-term amidation

SEQ ID NO: 1959 - protein, 38 aa, Artificial Sequence; identical to SEQ ID NO: 612
  Description of Artificial Sequence: Synthetic peptide
  n-term acetylation
  c-term amidation

SEQ ID NO: 1960 - protein, 37 aa, Artificial Sequence
  Description of Artificial Sequence: Synthetic peptide
TIINVKCKISAQCLKPCKDAGMRFGKCMNGKCHCTPK

SEQ ID NO: 1961 - protein, 37 aa, Artificial Sequence; identical to SEQ ID NO: 1960
  Description of Artificial Sequence: Synthetic peptide
  n-term acetylation

SEQ ID NO: 1962 - protein, 37 aa, Artificial Sequence; identical to SEQ ID NO: 1960
  Description of Artificial Sequence: Synthetic peptide
  c-term amidation

SEQ ID NO: 1963 - protein, 37 aa, Artificial Sequence; identical to SEQ ID NO: 1960
  Description of Artificial Sequence: Synthetic peptide
  n-term acetylation
  c-term amidation

SEQ ID NO: 1964 - protein, 38 aa, Artificial Sequence
  Description of Artificial Sequence: Synthetic peptide
GVKINVKCKISAQCLEPCKKAGMRFGKCMNGKCHCTPK

SEQ ID NO: 1965 - protein, 38 aa, Artificial Sequence; identical to SEQ ID NO: 1964
  Description of Artificial Sequence: Synthetic peptide
  n-term acetylation

SEQ ID NO: 1966 - protein, 38 aa, Artificial Sequence; identical to SEQ ID NO: 1964
  Description of Artificial Sequence: Synthetic peptide
  c-term amidation

SEQ ID NO: 1967 - protein, 38 aa, Artificial Sequence; identical to SEQ ID NO: 1964
  Description of Artificial Sequence: Synthetic peptide
  n-term acetylation
  c-term amidation

SEQ ID NO: 1968 - protein, 38 aa, Artificial Sequence
  Description of Artificial Sequence: Synthetic peptide
GVKINVKCKISAQCLEPCKKAGMRFGKCMNGKCACTPK

SEQ ID NO: 1969 - protein, 38 aa, Artificial Sequence
  Description of Artificial Sequence: Synthetic peptide
GVKINVKCKISAQCLKPCKDAGMRFGKCMNGKCHCTPK

SEQ ID NO: 1970 - protein, 38 aa, Artificial Sequence
  Description of Artificial Sequence: Synthetic peptide
GVKINVKCKISAQCLKPCKDAGMRFGKCMNGKCACTPK

SEQ ID NO: 1971 - protein, 38 aa, Artificial Sequence; identical to SEQ ID NO: 1968
  Description of Artificial Sequence: Synthetic peptide
  n-term acetylation

SEQ ID NO: 1972 - protein, 38 aa, Artificial Sequence; identical to SEQ ID NO: 1968
  Description of Artificial Sequence: Synthetic peptide
  c-term amidation

SEQ ID NO: 1973 - protein, 38 aa, Artificial Sequence; identical to SEQ ID NO: 1968
  Description of Artificial Sequence: Synthetic peptide
  n-term acetylation
  c-term amidation

SEQ ID NO: 1974 - protein, 38 aa, Artificial Sequence; identical to SEQ ID NO: 1970
  Description of Artificial Sequence: Synthetic peptide
  n-term acetylation

SEQ ID NO: 1975 - protein, 38 aa, Artificial Sequence; identical to SEQ ID NO: 1970
  Description of Artificial Sequence: Synthetic peptide
  c-term amidation

SEQ ID NO: 1976 - protein, 38 aa, Artificial Sequence; identical to SEQ ID NO: 1970
  Description of Artificial Sequence: Synthetic peptide
  n-term acetylation
  c-term amidation

SEQ ID NO: 1977 - protein, 38 aa, Artificial Sequence; identical to SEQ ID NO: 1969
  Description of Artificial Sequence: Synthetic peptide
  n-term acetylation

SEQ ID NO: 1978 - protein, 38 aa, Artificial Sequence; identical to SEQ ID NO: 1969
  Description of Artificial Sequence: Synthetic peptide
  c-term amidation

SEQ ID NO: 1979 - protein, 38 aa, Artificial Sequence; identical to SEQ ID NO: 1969
  Description of Artificial Sequence: Synthetic peptide
  n-term acetylation
  c-term amidation

SEQ ID NO: 1980 - protein, 36 aa, Artificial Sequence
  Description of Artificial Sequence: Synthetic peptide
GVIINVKCKISAQCLKPCKDAGMRFGKCMNGKCHCT

SEQ ID NO: 1981 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCHCTPK

SEQ ID NO: 1982 - protein, 38 aa, Artificial Sequence; identical to SEQ ID NO: 1981
  Description of Artificial Sequence: Synthetic peptide
  MOD_RES (16)..(16): hLys

SEQ ID NO: 1983 - protein, 38 aa, Artificial Sequence; identical to SEQ ID NO: 1981
  Description of Artificial Sequence: Synthetic peptide
  MOD_RES (16)..(16): hArg

SEQ ID NO: 1984 - protein, 38 aa, Artificial Sequence; identical to SEQ ID NO: 1981
  Description of Artificial Sequence: Synthetic peptide
  MOD_RES (16)..(16): Cit

SEQ ID NO: 1985 - protein, 38 aa, Artificial Sequence; identical to SEQ ID NO: 1981
  Description of Artificial Sequence: Synthetic peptide
  MOD_RES (16)..(16): hCit

SEQ ID NO: 1986 - protein, 38 aa, Artificial Sequence; identical to SEQ ID NO: 1981
  Description of Artificial Sequence: Synthetic peptide
  MOD_RES (16)..(16): Dpr

SEQ ID NO: 1987 - protein, 38 aa, Artificial Sequence; identical to SEQ ID NO: 1981
  Description of Artificial Sequence: Synthetic peptide
  MOD_RES (16)..(16): Dab

SEQ ID NO: 1988 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCHCYPK

SEQ ID NO: 1989 - protein, 38 aa, Artificial Sequence; identical to SEQ ID NO: 1988
  Description of Artificial Sequence: Synthetic peptide
  MOD_RES (16)..(16): hLys

SEQ ID NO: 1990 - protein, 38 aa, Artificial Sequence; identical to SEQ ID NO: 1988
  Description of Artificial Sequence: Synthetic peptide
  MOD_RES (16)..(16): hArg

SEQ ID NO: 1991 - protein, 38 aa, Artificial Sequence; identical to SEQ ID NO: 1988
  Description of Artificial Sequence: Synthetic peptide
  MOD_RES (16)..(16): Cit

SEQ ID NO: 1992 - protein, 38 aa, Artificial Sequence; identical to SEQ ID NO: 1988
  Description of Artificial Sequence: Synthetic peptide
  MOD_RES (16)..(16): hCit

SEQ ID NO: 1993 - protein, 38 aa, Artificial Sequence; identical to SEQ ID NO: 1988
  Description of Artificial Sequence: Synthetic peptide
  MOD_RES (16)..(16): Dpr

SEQ ID NO: 1994 - protein, 38 aa, Artificial Sequence; identical to SEQ ID NO: 1988
  Description of Artificial Sequence: Synthetic peptide
  MOD_RES (16)..(16): Dab

SEQ ID NO: 1995 - protein, 38 aa, Artificial Sequence
  Description of Artificial Sequence: Synthetic peptide
GVIINVKCKISAQCLKPCKDAGMRFGKCMNGKCACYPK

SEQ ID NO: 1996 - protein, 38 aa, Artificial Sequence
  Description of Artificial Sequence: Synthetic peptide
GVIINVKCKISAQCLKPCKDAGMRFGKCMNGKCGCYPK

SEQ ID NO: 1997 - protein, 38 aa, Artificial Sequence
  Description of Artificial Sequence: Synthetic peptide
GVIINVKCKISAQCLKPCKDAGMRFGKCMNGKCACFPK

SEQ ID NO: 1998 - protein, 38 aa, Artificial Sequence
  Description of Artificial Sequence: Synthetic peptide
GVIINVKCKISAQCLKPCKDAGMRFGKCMNGKCACWPK

SEQ ID NO: 1999 - protein, 38 aa, Artificial Sequence
  Description of Artificial Sequence: Synthetic peptide
GVIINVKCKISAQCLKPCKEAGMRFGKCMNGKCACYPK

SEQ ID NO: 2000 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCACTPK

SEQ ID NO: 2001 - protein, 38 aa, Artificial Sequence; identical to SEQ ID NO: 2000
  Description of Artificial Sequence: Synthetic peptide
  MOD_RES (16)..(16): hLys

SEQ ID NO: 2002 - protein, 38 aa, Artificial Sequence; identical to SEQ ID NO: 2000
  Description of Artificial Sequence: Synthetic peptide
  MOD_RES (16)..(16): hArg

SEQ ID NO: 2003 - protein, 38 aa, Artificial Sequence; identical to SEQ ID NO: 2000
  Description of Artificial Sequence: Synthetic peptide
  MOD_RES (16)..(16): Cit

SEQ ID NO: 2004 - protein, 38 aa, Artificial Sequence; identical to SEQ ID NO: 1981
  Description of Artificial Sequence: Synthetic peptide
  MOD_RES (16)..(16): hCit

SEQ ID NO: 2005 - protein, 38 aa, Artificial Sequence; identical to SEQ ID NO: 2000
  Description of Artificial Sequence: Synthetic peptide
  MOD_RES (16)..(16): Dpr

SEQ ID NO: 2006 - protein, 38 aa, Artificial Sequence; identical to SEQ ID NO: 2000
  Description of Artificial Sequence: Synthetic peptide
  MOD_RES (16)..(16): Dab

SEQ ID NO: 2007 - protein, 35 aa, Artificial Sequence
  Description of Artificial Sequence: Synthetic peptide
  MOD_RES (16)..(16): Orn
GVIINVKCKISAQCLXPCKDAGMRFGKCMNGKCHC

SEQ ID NO: 2008 - protein, 35 aa, Artificial Sequence; identical to SEQ ID NO: 2007
  Description of Artificial Sequence: Synthetic peptide
  MOD_RES (16)..(16): hLys

SEQ ID NO: 2009 - protein, 35 aa, Artificial Sequence; identical to SEQ ID NO: 2007
  Description of Artificial Sequence: Synthetic peptide
  MOD_RES (16)..(16): hArg

SEQ ID NO: 2010 - protein, 35 aa, Artificial Sequence; identical to SEQ ID NO: 2007
  Description of Artificial Sequence: Synthetic peptide
  MOD_RES (16)..(16): Cit

SEQ ID NO: 2011 - protein, 35 aa, Artificial Sequence; identical to SEQ ID NO: 2007
  Description of Artificial Sequence: Synthetic peptide
  MOD_RES (16)..(16): hCit

SEQ ID NO: 2012 - protein, 35 aa, Artificial Sequence; identical to SEQ ID NO: 2007
  Description of Artificial Sequence: Synthetic peptide
  MOD_RES (16)..(16): Dpr

SEQ ID NO: 2013 - protein, 35 aa, Artificial Sequence; identical to SEQ ID NO: 2007
  Description of Artificial Sequence: Synthetic peptide
  MOD_RES (16)..(16): Dab

SEQ ID NO: 2014 - protein, 35 aa, Artificial Sequence
  Description of Artificial Sequence: Synthetic peptide
  MOD_RES (16)..(16): Orn
GVIINVKCKISAQCLXPCKDAGMRFGKCMNGKCAC

SEQ ID NO: 2015 - protein, 35 aa, Artificial Sequence; identical to SEQ ID NO: 2014
  Description of Artificial Sequence: Synthetic peptide
  MOD_RES (16)..(16): hLys

SEQ ID NO: 2016 - protein, 35 aa, Artificial Sequence; identical to SEQ ID NO: 2014
  Description of Artificial Sequence: Synthetic peptide
  MOD_RES (16)..(16): hArg

SEQ ID NO: 2017 - protein, 35 aa, Artificial Sequence; identical to SEQ ID NO: 2014
  Description of Artificial Sequence: Synthetic peptide
  MOD_RES (16)..(16): Cit

SEQ ID NO: 2018 - protein, 35 aa, Artificial Sequence; identical to SEQ ID NO: 2007
  Description of Artificial Sequence: Synthetic peptide
  MOD_RES (16)..(16): hCit

SEQ ID NO: 2019 - protein, 35 aa, Artificial Sequence; identical to SEQ ID NO: 2014
  Description of Artificial Sequence: Synthetic peptide
  MOD_RES (16)..(16): Dpr

SEQ ID NO: 2020 - protein, 35 aa, Artificial Sequence; identical to SEQ ID NO: 2014
  Description of Artificial Sequence: Synthetic peptide
  MOD_RES (16)..(16): Dab

SEQ ID NO: 2021 - protein, 38 aa, Artificial Sequence
  Description of Artificial Sequence: Synthetic peptide
GVIINVKCKISAQCLKPCKDAGMRFGKCMNGKCGCYGG

SEQ ID NO: 2022 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCHCYGG

SEQ ID NO: 2023 - protein, 38 aa, Artificial Sequence; identical to SEQ ID NO: 2022
  Description of Artificial Sequence: Synthetic peptide
  MOD_RES (16)..(16): hLys

SEQ ID NO: 2024 - protein, 38 aa, Artificial Sequence; identical to SEQ ID NO: 2022
  Description of Artificial Sequence: Synthetic peptide
  MOD_RES (16)..(16): hArg

SEQ ID NO: 2025 - protein, 38 aa, Artificial Sequence; identical to SEQ ID NO: 2022
  Description of Artificial Sequence: Synthetic peptide
  MOD_RES (16)..(16): Cit

SEQ ID NO: 2026 - protein, 38 aa, Artificial Sequence; identical to SEQ ID NO: 2022
  Description of Artificial Sequence: Synthetic peptide
  MOD_RES (16)..(16): hCit

SEQ ID NO: 2027 - protein, 38 aa, Artificial Sequence; identical to SEQ ID NO: 2022
  Description of Artificial Sequence: Synthetic peptide
  MOD_RES (16)..(16): Dpr

SEQ ID NO: 2028 - protein, 38 aa, Artificial Sequence
  Description of Artificial Sequence: Synthetic peptide
GVIINVKCKISAQCLKPCKDAGMRFGKCMNGKCACYGG

SEQ ID NO: 2029 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCACYGG

SEQ ID NO: 2030 - protein, 38 aa, Artificial Sequence; identical to SEQ ID NO: 2029
  Description of Artificial Sequence: Synthetic peptide
  MOD_RES (16)..(16): hLys

SEQ ID NO: 2031 - protein, 38 aa, Artificial Sequence; identical to SEQ ID NO: 2029
  Description of Artificial Sequence: Synthetic peptide
  MOD_RES (16)..(16): hArg

SEQ ID NO: 2032 - protein, 38 aa, Artificial Sequence; identical to SEQ ID NO: 2029
  Description of Artificial Sequence: Synthetic peptide
  MOD_RES (16)..(16): Cit

SEQ ID NO: 2033 - protein, 38 aa, Artificial Sequence; identical to SEQ ID NO: 2022
  Description of Artificial Sequence: Synthetic peptide
  MOD_RES (16)..(16): hCit

SEQ ID NO: 2034 - protein, 38 aa, Artificial Sequence; identical to SEQ ID NO: 2029
  Description of Artificial Sequence: Synthetic peptide
  MOD_RES (16)..(16): Dpr

SEQ ID NO: 2035 - protein, 38 aa, Artificial Sequence; identical to SEQ ID NO: 2029
  Description of Artificial Sequence: Synthetic peptide
  MOD_RES (16)..(16): Dab

SEQ ID NO: 2036 - protein, 37 aa, Artificial Sequence
  Description of Artificial Sequence: Synthetic peptide
GVIINVKCKISAQCLKPCKDAGMRFGKCMNGKCACYG

SEQ ID NO: 2037 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCHCGGG

SEQ ID NO: 2038 - protein, 38 aa, Artificial Sequence; identical to SEQ ID NO: 2037
  Description of Artificial Sequence: Synthetic peptide
  MOD_RES (16)..(16): hLys

SEQ ID NO: 2039 - protein, 38 aa, Artificial Sequence; identical to SEQ ID NO: 2037
  Description of Artificial Sequence: Synthetic peptide
  MOD_RES (16)..(16): hArg

SEQ ID NO: 2040 - protein, 38 aa, Artificial Sequence; identical to SEQ ID NO: 2037
  Description of Artificial Sequence: Synthetic peptide
  MOD_RES (16)..(16): Cit

SEQ ID NO: 2041 - protein, 38 aa, Artificial Sequence; identical to SEQ ID NO: 2037
  Description of Artificial Sequence: Synthetic peptide
  MOD_RES (16)..(16): hCit

SEQ ID NO: 2042 - protein, 38 aa, Artificial Sequence; identical to SEQ ID NO: 2037
  Description of Artificial Sequence: Synthetic peptide
  MOD_RES (16)..(16): Dpr

SEQ ID NO: 2043 - protein, 38 aa, Artificial Sequence
  Description of Artificial Sequence: Synthetic peptide
GVIINVKCKISAQCLKPCKDAGMRFGKCMNGKCACFGG

SEQ ID NO: 2044 - protein, 38 aa, Artificial Sequence
  Description of Artificial Sequence: Synthetic peptide
  MOD_RES (16)..(16): Orn
GVIINVKCKISAQCLXPCKDAGMRFGKCMNGKCACGGG

SEQ ID NO: 2045 - protein, 38 aa, Artificial Sequence; identical to SEQ ID NO: 2044
  Description of Artificial Sequence: Synthetic peptide
  MOD_RES (16)..(16): hLys

SEQ ID NO: 2046 - protein, 38 aa, Artificial Sequence; identical to SEQ ID NO: 2044
  Description of Artificial Sequence: Synthetic peptide
  MOD_RES (16)..(16): hArg

SEQ ID NO: 2047 - protein, 38 aa, Artificial Sequence; identical to SEQ ID NO: 2044
  Description of Artificial Sequence: Synthetic peptide
  MOD_RES (16)..(16): Cit

SEQ ID NO: 2048 - protein, 38 aa, Artificial Sequence; identical to SEQ ID NO: 2044
  Description of Artificial Sequence: Synthetic peptide
  MOD_RES (16)..(16): hCit

SEQ ID NO: 2049 - protein, 38 aa, Artificial Sequence; identical to SEQ ID NO: 2044
  Description of Artificial Sequence: Synthetic peptide
  MOD_RES (16)..(16): Dpr

SEQ ID NO: 2050 - protein, 38 aa, Artificial Sequence; identical to SEQ ID NO: 2044
  Description of Artificial Sequence: Synthetic peptide
  MOD_RES (16)..(16): Dab

SEQ ID NO: 2051 - protein, 37 aa, Artificial Sequence
  Description of Artificial Sequence: Synthetic peptide
GVIINVKCKISAQCLKPCKDAGMRFGKCMNGKCACGG

SEQ ID NO: 2052 - protein, 37 aa, Artificial Sequence; identical to SEQ ID NO: 2036
  Description of Artificial Sequence: Synthetic peptide

SEQ ID NO: 2053 - protein, 37 aa, Artificial Sequence
  Description of Artificial Sequence: Synthetic peptide
  MOD_RES (16)..(16): Orn
GVIINVKCKISAQCLXPCKDAGMRFGKCMNGKCACGG

SEQ ID NO: 2054 - protein, 38 aa, Artificial Sequence
  Description of Artificial Sequence: Synthetic peptide
  MOD_RES (16)..(16): hLys
GVIINVKCKISAQCLXPCKEAGMRFGKCMNGKCHCTPK

SEQ ID NO: 2055 - protein, 38 aa, Artificial Sequence; identical to SEQ ID NO: 2054
  Description of Artificial Sequence: Synthetic peptide
  MOD_RES (16)..(16): hArg

SEQ ID NO: 2056 - protein, 38 aa, Artificial Sequence; identical to SEQ ID NO: 2054
  Description of Artificial Sequence: Synthetic peptide
  MOD_RES (16)..(16): Cit

SEQ ID NO: 2057 - protein, 38 aa, Artificial Sequence; identical to SEQ ID NO: 2054
  Description of Artificial Sequence: Synthetic peptide
  MOD_RES (16)..(16): hCit

SEQ ID NO: 2058 - protein, 38 aa, Artificial Sequence; identical to SEQ ID NO: 2054
  Description of Artificial Sequence: Synthetic peptide
  MOD_RES (16)..(16): Dpr

SEQ ID NO: 2059 - protein, 38 aa, Artificial Sequence; identical to SEQ ID NO: 2054
  Description of Artificial Sequence: Synthetic peptide
  MOD_RES (16)..(16): Dab

SEQ ID NO: 2060 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCHCYPK

SEQ ID NO: 2061 - protein, 38 aa, Artificial Sequence; identical to SEQ ID NO: 2060
  Description of Artificial Sequence: Synthetic peptide
  MOD_RES (16)..(16): hLys

SEQ ID NO: 2062 - protein, 38 aa, Artificial Sequence; identical to SEQ ID NO: 2060
  Description of Artificial Sequence: Synthetic peptide
  MOD_RES (16)..(16): hArg

SEQ ID NO: 2063 - protein, 38 aa, Artificial Sequence; identical to SEQ ID NO: 2060
  Description of Artificial Sequence: Synthetic peptide
  MOD_RES (16)..(16): Cit

SEQ ID NO: 2064 - protein, 38 aa, Artificial Sequence; identical to SEQ ID NO: 2060
  Description of Artificial Sequence: Synthetic peptide
  MOD_RES (16)..(16): hCit

SEQ ID NO: 2065 - protein, 38 aa, Artificial Sequence; identical to SEQ ID NO: 2060
  Description of Artificial Sequence: Synthetic peptide
  MOD_RES (16)..(16): Dpr

SEQ ID NO: 2066 - protein, 38 aa, Artificial Sequence; identical to SEQ ID NO: 2060
  Description of Artificial Sequence: Synthetic peptide
  MOD_RES (16)..(16): Dab

SEQ ID NO: 2067 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCACTPK

SEQ ID NO: 2068 - protein, 38 aa, Artificial Sequence; identical to SEQ ID NO: 2067
  Description of Artificial Sequence: Synthetic peptide
  MOD_RES (16)..(16): hLys

SEQ ID NO: 2069 - protein, 38 aa, Artificial Sequence; identical to SEQ ID NO: 2067
  Description of Artificial Sequence: Synthetic peptide
  MOD_RES (16)..(16): hArg

SEQ ID NO: 2070 - protein, 38 aa, Artificial Sequence; identical to SEQ ID NO: 2067
  Description of Artificial Sequence: Synthetic peptide
  MOD_RES (16)..(16): Cit

SEQ ID NO: 2071 - protein, 38 aa, Artificial Sequence; identical to SEQ ID NO: 2054
  Description of Artificial Sequence: Synthetic peptide
  MOD_RES (16)..(16): hCit

SEQ ID NO: 2072 - protein, 38 aa, Artificial Sequence; identical to SEQ ID NO: 2067
  Description of Artificial Sequence: Synthetic peptide
  MOD_RES (16)..(16): Dpr

SEQ ID NO: 2073 - protein, 38 aa, Artificial Sequence; identical to SEQ ID NO: 2067
  Description of Artificial Sequence: Synthetic peptide
  MOD_RES (16)..(16): Dab

SEQ ID NO: 2074 - protein, 35 aa, Artificial Sequence
  Description of Artificial Sequence: Synthetic peptide
  MOD_RES (16)..(16): Orn
GVIINVKCKISAQCLXPCKEAGMRFGKCMNGKCHC

SEQ ID NO: 2075 - protein, 35 aa, Artificial Sequence; identical to SEQ ID NO: 2074
  Description of Artificial Sequence: Synthetic peptide
  MOD_RES (16)..(16): hLys

SEQ ID NO: 2076 - protein, 35 aa, Artificial Sequence; identical to SEQ ID NO: 2074
  Description of Artificial Sequence: Synthetic peptide
  MOD_RES (16)..(16): hArg

SEQ ID NO: 2077 - protein, 35 aa, Artificial Sequence; identical to SEQ ID NO: 2074
  Description of Artificial Sequence: Synthetic peptide
  MOD_RES (16)..(16): Cit

SEQ ID NO: 2078 - protein, 35 aa, Artificial Sequence; identical to SEQ ID NO: 2074
  Description of Artificial Sequence: Synthetic peptide
  MOD_RES (16)..(16): hCit

SEQ ID NO: 2079 - protein, 35 aa, Artificial Sequence; identical to SEQ ID NO: 2074
  Description of Artificial Sequence: Synthetic peptide
  MOD_RES (16)..(16): Dpr

SEQ ID NO: 2080 - protein, 35 aa, Artificial Sequence
  Description of Artificial Sequence: Synthetic peptide
  MOD_RES (16)..(16): Orn
GVIINVKCKISAQCLXPCKEAGMRFGKCMNGKCAC

SEQ ID NO: 2081 - protein, 35 aa, Artificial Sequence; identical to SEQ ID NO: 2080
  Description of Artificial Sequence: Synthetic peptide
  MOD_RES (16)..(16): hLys

SEQ ID NO: 2082 - protein, 35 aa, Artificial Sequence; identical to SEQ ID NO: 2080
  Description of Artificial Sequence: Synthetic peptide
  MOD_RES (16)..(16): hArg

SEQ ID NO: 2083 - protein, 35 aa, Artificial Sequence; identical to SEQ ID NO: 2080
  Description of Artificial Sequence: Synthetic peptide
  MOD_RES (16)..(16): Cit

SEQ ID NO: 2084 - protein, 35 aa, Artificial Sequence; identical to SEQ ID NO: 2074
  Description of Artificial Sequence: Synthetic peptide
  MOD_RES (16)..(16): hCit

SEQ ID NO: 2085 - protein, 35 aa, Artificial Sequence; identical to SEQ ID NO: 2080
  Description of Artificial Sequence: Synthetic peptide
  MOD_RES (16)..(16): Dpr

SEQ ID NO: 2086 - protein, 35 aa, Artificial Sequence; identical to SEQ ID NO: 2080
  Description of Artificial Sequence: Synthetic peptide
  MOD_RES (16)..(16): Dab

SEQ ID NO: 2087 - protein, 38 aa, Artificial Sequence
  Description of Artificial Sequence: Synthetic peptide
GVIINVKCKISAQCLKPCKEAGMRFGKCMNGKCHCYGG

SEQ ID NO: 2088 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCHCYGG

SEQ ID NO: 2089 - protein, 37 aa, Artificial Sequence
  Description of Artificial Sequence: Synthetic peptide
GVIINVKCKISAQCLKPCKEAGMRFGKCMNGKCHCYG

SEQ ID NO: 2090 - protein, 37 aa, Artificial Sequence
  Description of Artificial Sequence: Synthetic peptide
GVIINVKCKISAQCLKPCKEAGMRFGKCMNGKCACYG

SEQ ID NO: 2091 - protein, 38 aa, Artificial Sequence; identical to SEQ ID NO: 2088
  Description of Artificial Sequence: Synthetic peptide
  MOD_RES (16)..(16): hLys

SEQ ID NO: 2092 - protein, 38 aa, Artificial Sequence; identical to SEQ ID NO: 2088
  Description of Artificial Sequence: Synthetic peptide
  MOD_RES (16)..(16): hArg

SEQ ID NO: 2093 - protein, 38 aa, Artificial Sequence; identical to SEQ ID NO: 2088
  Description of Artificial Sequence: Synthetic peptide
  MOD_RES (16)..(16): Cit

SEQ ID NO: 2094 - protein, 38 aa, Artificial Sequence; identical to SEQ ID NO: 2088
  Description of Artificial Sequence: Synthetic peptide
  MOD_RES (16)..(16): hCit

SEQ ID NO: 2095 - protein, 38 aa, Artificial Sequence; identical to SEQ ID NO: 2088
  Description of Artificial Sequence: Synthetic peptide
  MOD_RES (16)..(16): Dpr

SEQ ID NO: 2096 - protein, 38 aa, Artificial Sequence; identical to SEQ ID NO: 2088
  Description of Artificial Sequence: Synthetic peptide
  MOD_RES (16)..(16): Dab

SEQ ID NO: 2097 - protein, 37 aa, Artificial Sequence; identical to SEQ ID NO: 2090
  Description of Artificial Sequence: Synthetic peptide

SEQ ID NO: 2098 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCACYGG

SEQ ID NO: 2099 - protein, 38 aa, Artificial Sequence; identical to SEQ ID NO: 2098
  Description of Artificial Sequence: Synthetic peptide
  MOD_RES (16)..(16): hLys

SEQ ID NO: 2100 - protein, 38 aa, Artificial Sequence; identical to SEQ ID NO: 2098
  Description of Artificial Sequence: Synthetic peptide
  MOD_RES (16)..(16): hArg

SEQ ID NO: 2101 - protein, 38 aa, Artificial Sequence; identical to SEQ ID NO: 2098
  Description of Artificial Sequence: Synthetic peptide
  MOD_RES (16)..(16): Cit

SEQ ID NO: 2102 - protein, 38 aa, Artificial Sequence; identical to SEQ ID NO: 2088
  Description of Artificial Sequence: Synthetic peptide
  MOD_RES (16)..(16): hCit

SEQ ID NO: 2103 - protein, 38 aa, Artificial Sequence; identical to SEQ ID NO: 2098
  Description of Artificial Sequence: Synthetic peptide
  MOD_RES (16)..(16): Dpr

SEQ ID NO: 2104 - protein, 38 aa, Artificial Sequence; identical to SEQ ID NO: 2098
  Description of Artificial Sequence: Synthetic peptide
  MOD_RES (16)..(16): Dab

SEQ ID NO: 2105 - protein, 38 aa, Artificial Sequence
  Description of Artificial Sequence: Synthetic peptide
GVIINVKCKISAQCLKPCKEAGMRFGKCMNGKCACFGG

SEQ ID NO: 2106 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCHCGGG

SEQ ID NO: 2107 - protein, 38 aa, Artificial Sequence; identical to SEQ ID NO: 2106
  Description of Artificial Sequence: Synthetic peptide
  MOD_RES (16)..(16): hLys

SEQ ID NO: 2108 - protein, 38 aa, Artificial Sequence; identical to SEQ ID NO: 2106
  Description of Artificial Sequence: Synthetic peptide
  MOD_RES (16)..(16): hArg

SEQ ID NO: 2109 - protein, 38 aa, Artificial Sequence; identical to SEQ ID NO: 2106
  Description of Artificial Sequence: Synthetic peptide
  MOD_RES (16)..(16): Cit

SEQ ID NO: 2110 - protein, 38 aa, Artificial Sequence; identical to SEQ ID NO: 2106
  Description of Artificial Sequence: Synthetic peptide
  MOD_RES (16)..(16): hCit

SEQ ID NO: 2111 - protein, 38 aa, Artificial Sequence; identical to SEQ ID NO: 2106
  Description of Artificial Sequence: Synthetic peptide
  MOD_RES (16)..(16): Dpr

SEQ ID NO: 2112 - protein, 38 aa, Artificial Sequence
  Description of Artificial Sequence: Synthetic peptide
  MOD_RES (16)..(16): Orn
GVIINVKCKISAQCLXPCKEAGMRFGKCMNGKCACGGG

SEQ ID NO: 2113 - protein, 38 aa, Artificial Sequence; identical to SEQ ID NO: 2112
  Description of Artificial Sequence: Synthetic peptide
  MOD_RES (16)..(16): hLys

SEQ ID NO: 2114 - protein, 38 aa, Artificial Sequence; identical to SEQ ID NO: 2112
  Description of Artificial Sequence: Synthetic peptide
  MOD_RES (16)..(16): hArg

SEQ ID NO: 2115 - protein, 38 aa, Artificial Sequence; identical to SEQ ID NO: 2112
  Description of Artificial Sequence: Synthetic peptide
  MOD_RES (16)..(16): Cit

SEQ ID NO: 2116 - protein, 37 aa, Artificial Sequence
  Description of Artificial Sequence: Synthetic peptide
  MOD_RES (16)..(16): hCit
GVIINVKCKISAQCLXPCKEAGMRFGKCMNGKCACTP

SEQ ID NO: 2117 - protein, 37 aa, Artificial Sequence; identical to SEQ ID NO: 2116
  Description of Artificial Sequence: Synthetic peptide
  MOD_RES (16)..(16): Dpr

SEQ ID NO: 2118 - protein, 37 aa, Artificial Sequence; identical to SEQ ID NO: 2116
  Description of Artificial Sequence: Synthetic peptide
  MOD_RES (16)..(16): Dab

SEQ ID NO: 2119 - protein, 38 aa, Artificial Sequence; identical to SEQ ID NO: 1981
  Description of Artificial Sequence: Synthetic peptide
  MOD_RES (16)..(16): Orn
  c-term amidation

SEQ ID NO: 2120 - protein, 38 aa, Artificial Sequence; identical to SEQ ID NO: 1981
  Description of Artificial Sequence: Synthetic peptide
  MOD_RES (16)..(16): hLys
  c-term amidation

SEQ ID NO: 2121 - protein, 38 aa, Artificial Sequence; identical to SEQ ID NO: 1981
  Description of Artificial Sequence: Synthetic peptide
  MOD_RES (16)..(16): hArg
  c-term amidation

SEQ ID NO: 2122 - protein, 38 aa, Artificial Sequence; identical to SEQ ID NO: 1981
  Description of Artificial Sequence: Synthetic peptide
  MOD_RES (16)..(16): Cit
  c-term amidation

SEQ ID NO: 2123 - protein, 38 aa, Artificial Sequence; identical to SEQ ID NO: 1981
  Description of Artificial Sequence: Synthetic peptide
  MOD_RES (16)..(16): hCit
  c-term amidation

SEQ ID NO: 2124 - protein, 38 aa, Artificial Sequence; identical to SEQ ID NO: 1981
  Description of Artificial Sequence: Synthetic peptide
  MOD_RES (16)..(16): Dpr
  c-term amidation

SEQ ID NO: 2125 - protein, 38 aa, Artificial Sequence; identical to SEQ ID NO: 1981
  Description of Artificial Sequence: Synthetic peptide
  MOD_RES (16)..(16): Dab
  c-term amidation

SEQ ID NO: 2126 - protein, 38 aa, Artificial Sequence; identical to SEQ ID NO: 1988
  Description of Artificial Sequence: Synthetic peptide
  MOD_RES (16)..(16): Orn
  c-term amidation

SEQ ID NO: 2127 - protein, 38 aa, Artificial Sequence; identical to SEQ ID NO: 1988
  Description of Artificial Sequence: Synthetic peptide
  MOD_RES (16)..(16): hLys
  c-term amidation

SEQ ID NO: 2128 - protein, 38 aa, Artificial Sequence; identical to SEQ ID NO: 1988
  Description of Artificial Sequence: Synthetic peptide
  MOD_RES (16)..(16): hArg
  c-term amidation

SEQ ID NO: 2129 - protein, 38 aa, Artificial Sequence; identical to SEQ ID NO: 1988
  Description of Artificial Sequence: Synthetic peptide
  MOD_RES (16)..(16): Cit
  c-term amidation

SEQ ID NO: 2130 - protein, 38 aa, Artificial Sequence; identical to SEQ ID NO: 1988
  Description of Artificial Sequence: Synthetic peptide
  MOD_RES (16)..(16): hCit
  c-term amidation

SEQ ID NO: 2131 - protein, 38 aa, Artificial Sequence; identical to SEQ ID NO: 1988
  Description of Artificial Sequence: Synthetic peptide
  MOD_RES (16)..(16): Dpr
  c-term amidation

SEQ ID NO: 2132 - protein, 38 aa, Artificial Sequence; identical to SEQ ID NO: 1988
  Description of Artificial Sequence: Synthetic peptide
  MOD_RES (16)..(16): Dab
  c-term amidation

SEQ ID NO: 2133 - protein, 38 aa, Artificial Sequence; identical to SEQ ID NO: 2000
  Description of Artificial Sequence: Synthetic peptide
  MOD_RES (16)..(16): Orn
  c-term amidation

SEQ ID NO: 2134 - protein, 38 aa, Artificial Sequence; identical to SEQ ID NO: 2000
  Description of Artificial Sequence: Synthetic peptide
  MOD_RES (16)..(16): hLys
  c-term amidation

SEQ ID NO: 2135 - protein, 38 aa, Artificial Sequence; identical to SEQ ID NO: 2000
  Description of Artificial Sequence: Synthetic peptide
  MOD_RES (16)..(16): hArg
  c-term amidation

SEQ ID NO: 2136 - protein, 38 aa, Artificial Sequence; identical to SEQ ID NO: 2000
  Description of Artificial Sequence: Synthetic peptide
  MOD_RES (16)..(16): Cit
  c-term amidation

SEQ ID NO: 2137 - protein, 38 aa, Artificial Sequence; identical to SEQ ID NO: 2000
  Description of Artificial Sequence: Synthetic peptide
  MOD_RES (16)..(16): hCit
  c-term amidation

SEQ ID NO: 2138 - protein, 38 aa, Artificial Sequence; identical to SEQ ID NO: 2000
  Description of Artificial Sequence: Synthetic peptide
  MOD_RES (16)..(16): Dpr
  c-term amidation

SEQ ID NO: 2139 - protein, 38 aa, Artificial Sequence; identical to SEQ ID NO: 2000
  Description of Artificial Sequence: Synthetic peptide
  MOD_RES (16)..(16): Dab
  c-term amidation

SEQ ID NO: 2140 - protein, 35 aa, Artificial Sequence; identical to SEQ ID NO: 2007
  Description of Artificial Sequence: Synthetic peptide
  MOD_RES (16)..(16): Orn
  c-term amidation

SEQ ID NO: 2141 - protein, 35 aa, Artificial Sequence; identical to SEQ ID NO: 2007
  Description of Artificial Sequence: Synthetic peptide
  MOD_RES (16)..(16): hLys
  c-term amidation

SEQ ID NO: 2142 - protein, 35 aa, Artificial Sequence; identical to SEQ ID NO: 2007
  Description of Artificial Sequence: Synthetic peptide
  MOD_RES (16)..(16): hArg
  c-term amidation

SEQ ID NO: 2143 - protein, 35 aa, Artificial Sequence; identical to SEQ ID NO: 2007
  Description of Artificial Sequence: Synthetic peptide
  MOD_RES (16)..(16): Cit
  c-term amidation

SEQ ID NO: 2144 - protein, 35 aa, Artificial Sequence; identical to SEQ ID NO: 2007
  Description of Artificial Sequence: Synthetic peptide
  MOD_RES (16)..(16): hCit
  c-term amidation

SEQ ID NO: 2145 - protein, 35 aa, Artificial Sequence; identical to SEQ ID NO: 2007
  Description of Artificial Sequence: Synthetic peptide
  MOD_RES (16)..(16): Dpr
  c-term amidation

SEQ ID NO: 2146 - protein, 33 aa, Artificial Sequence
  Description of Artificial Sequence: Synthetic peptide
  MOD_RES (16)..(16): Orn
  c-term amidation
GVIINVKCKISAQCLXPCKDAGMRFGKCMNGKC

SEQ ID NO: 2147 - protein, 33 aa, Artificial Sequence; identical to SEQ ID NO: 2146
  Description of Artificial Sequence: Synthetic peptide
  MOD_RES (16)..(16): hLys
  c-term amidation

SEQ ID NO: 2148 - protein, 33 aa, Artificial Sequence; identical to SEQ ID NO: 2146
  Description of Artificial Sequence: Synthetic peptide
  MOD_RES (16)..(16): hArg
  c-term amidation

SEQ ID NO: 2149 - protein, 33 aa, Artificial Sequence; identical to SEQ ID NO: 2146
  Description of Artificial Sequence: Synthetic peptide
  MOD_RES (16)..(16): Cit
  c-term amidation

SEQ ID NO: 2150 - protein, 35 aa, Artificial Sequence; identical to SEQ ID NO: 2007
  Description of Artificial Sequence: Synthetic peptide
  MOD_RES (16)..(16): hCit
  c-term amidation

SEQ ID NO: 2151 - protein, 33 aa, Artificial Sequence; identical to SEQ ID NO: 2146
  Description of Artificial Sequence: Synthetic peptide
  MOD_RES (16)..(16): Dpr
  c-term amidation

SEQ ID NO: 2152 - protein, 33 aa, Artificial Sequence; identical to SEQ ID NO: 2146
  Description of Artificial Sequence: Synthetic peptide
  MOD_RES (16)..(16): Dab
  c-term amidation

SEQ ID NO: 2153 - protein, 38 aa, Artificial Sequence
  Description of Artificial Sequence: Synthetic peptide
  c-term amidation
GVIINVKCKISAQCLKPCKDAGMRFGKCMNGKCHCYGG

SEQ ID NO: 2154 - protein, 38 aa, Artificial Sequence; identical to SEQ ID NO: 2022
  Description of Artificial Sequence: Synthetic peptide
  MOD_RES (16)..(16): Orn
  c-term amidation

SEQ ID NO: 2155 - protein, 38 aa, Artificial Sequence; identical to SEQ ID NO: 2022
  Description of Artificial Sequence: Synthetic peptide
  MOD_RES (16)..(16): hLys
  c-term amidation

SEQ ID NO: 2156 - protein, 38 aa, Artificial Sequence; identical to SEQ ID NO: 2022
  Description of Artificial Sequence: Synthetic peptide
  MOD_RES (16)..(16): hArg
  c-term amidation

SEQ ID NO: 2157 - protein, 38 aa, Artificial Sequence; identical to SEQ ID NO: 2022
  Description of Artificial Sequence: Synthetic peptide
  MOD_RES (16)..(16): Cit
  c-term amidation

SEQ ID NO: 2158 - protein, 38 aa, Artificial Sequence; identical to SEQ ID NO: 2022
  Description of Artificial Sequence: Synthetic peptide
  MOD_RES (16)..(16): hCit
  c-term amidation

SEQ ID NO: 2159 - protein, 38 aa, Artificial Sequence; identical to SEQ ID NO: 2022
  Description of Artificial Sequence: Synthetic peptide
  MOD_RES (16)..(16): Dpr
  c-term amidation

SEQ ID NO: 2160 - protein, 38 aa, Artificial Sequence
  Description of Artificial Sequence: Synthetic peptide
  c-term amidation
GVIINVKCKISAQCLKPCKDAGMRFGKCMNGKCHCFGG

SEQ ID NO: 2161 - protein, 37 aa, Artificial Sequence
  Description of Artificial Sequence: Synthetic peptide
  c-term amidation
GVIINVKCKISAQCLKPCKDAGMRFGKCMNGKCHCYG

SEQ ID NO: 2162 - protein, 37 aa, Artificial Sequence; identical to SEQ ID NO: 2036
  Description of Artificial Sequence: Synthetic peptide
  c-term amidation

SEQ ID NO: 2163 - protein, 38 aa, Artificial Sequence; identical to SEQ ID NO: 2029
  Description of Artificial Sequence: Synthetic peptide
  MOD_RES (16)..(16): Orn
  c-term amidation

SEQ ID NO: 2164 - protein, 38 aa, Artificial Sequence; identical to SEQ ID NO: 2029
  Description of Artificial Sequence: Synthetic peptide
  MOD_RES (16)..(16): hLys
  c-term amidation

SEQ ID NO: 2165 - protein, 38 aa, Artificial Sequence; identical to SEQ ID NO: 2029
  Description of Artificial Sequence: Synthetic peptide
  MOD_RES (16)..(16): hArg
  c-term amidation

SEQ ID NO: 2166 - protein, 38 aa, Artificial Sequence; identical to SEQ ID NO: 2029
  Description of Artificial Sequence: Synthetic peptide
  MOD_RES (16)..(16): Cit
  c-term amidation

SEQ ID NO: 2167 - protein, 38 aa, Artificial Sequence; identical to SEQ ID NO: 2029
  Description of Artificial Sequence: Synthetic peptide
  MOD_RES (16)..(16): hCit
  c-term amidation

SEQ ID NO: 2168 - protein, 38 aa, Artificial Sequence; identical to SEQ ID NO: 2029
  Description of Artificial Sequence: Synthetic peptide
  MOD_RES (16)..(16): Dpr
  c-term amidation

SEQ ID NO: 2169 - protein, 38 aa, Artificial Sequence; identical to SEQ ID NO: 2029
  Description of Artificial Sequence: Synthetic peptide
  MOD_RES (16)..(16): Dab
  c-term amidation

SEQ ID NO: 2170 - protein, 38 aa, Artificial Sequence; identical to SEQ ID NO: 2028
  Description of Artificial Sequence: Synthetic peptide
  c-term amidation

SEQ ID NO: 2171 - protein, 38 aa, Artificial Sequence; identical to SEQ ID NO: 2037
  Description of Artificial Sequence: Synthetic peptide
  MOD_RES (16)..(16): Orn
  c-term amidation

SEQ ID NO: 2172 - protein, 38 aa, Artificial Sequence; identical to SEQ ID NO: 2037
  Description of Artificial Sequence: Synthetic peptide
  MOD_RES (16)..(16): hLys
  c-term amidation

SEQ ID NO: 2173 - protein, 38 aa, Artificial Sequence; identical to SEQ ID NO: 2037
  Description of Artificial Sequence: Synthetic peptide
  MOD_RES (16)..(16): hArg
  c-term amidation

SEQ ID NO: 2174 - protein, 38 aa, Artificial Sequence; identical to SEQ ID NO: 2037
  Description of Artificial Sequence: Synthetic peptide
  MOD_RES (16)..(16): Cit
  c-term amidation

SEQ ID NO: 2175 - protein, 38 aa, Artificial Sequence; identical to SEQ ID NO: 2037
  Description of Artificial Sequence: Synthetic peptide
  MOD_RES (16)..(16): hCit
  c-term amidation

SEQ ID NO: 2176 - protein, 38 aa, Artificial Sequence; identical to SEQ ID NO: 2037
  Description of Artificial Sequence: Synthetic peptide
  MOD_RES (16)..(16): Dpr
  c-term amidation

SEQ ID NO: 2177 - protein, 38 aa, Artificial Sequence
  Description of Artificial Sequence: Synthetic peptide
  c-term amidation
GVIINVKCKISAQCLKPCKDAGMRFGKCMNGKCACGGG

SEQ ID NO: 2178 - protein, 38 aa, Artificial Sequence
  Description of Artificial Sequence: Synthetic peptide
  MOD_RES (16)..(16): Orn
  c-term amidation
GVIINVKCKISAQCLXPCKDAGMRFGKCMNGKCACFGG

SEQ ID NO: 2179 - protein, 38 aa, Artificial Sequence; identical to SEQ ID NO: 2044
  Description of Artificial Sequence: Synthetic peptide
  MOD_RES (16)..(16): Orn
  c-term amidation

SEQ ID NO: 2180 - protein, 38 aa, Artificial Sequence; identical to SEQ ID NO: 2044
  Description of Artificial Sequence: Synthetic peptide
  MOD_RES (16)..(16): hLys
  c-term amidation

SEQ ID NO: 2181 - protein, 38 aa, Artificial Sequence; identical to SEQ ID NO: 2044
  Description of Artificial Sequence: Synthetic peptide
  MOD_RES (16)..(16): hArg
  c-term amidation

SEQ ID NO: 2182 - protein, 38 aa, Artificial Sequence; identical to SEQ ID NO: 2044
  Description of Artificial Sequence: Synthetic peptide
  MOD_RES (16)..(16): Cit
  c-term amidation

SEQ ID NO: 2183 - protein, 38 aa, Artificial Sequence; identical to SEQ ID NO: 2044
  Description of Artificial Sequence: Synthetic peptide
  MOD_RES (16)..(16): hCit
  c-term amidation

SEQ ID NO: 2184 - protein, 38 aa, Artificial Sequence; identical to SEQ ID NO: 2044
  Description of Artificial Sequence: Synthetic peptide
  MOD_RES (16)..(16): Dpr
  c-term amidation

SEQ ID NO: 2185 - protein, 38 aa, Artificial Sequence; identical to SEQ ID NO: 2044
  Description of Artificial Sequence: Synthetic peptide
  MOD_RES (16)..(16): Dab
  c-term amidation

SEQ ID NO: 2186 - protein, 38 aa, Artificial Sequence; identical to SEQ ID NO: 2054
  Description of Artificial Sequence: Synthetic peptide
  MOD_RES (16)..(16): Orn
  c-term amidation

SEQ ID NO: 2187 - protein, 38 aa, Artificial Sequence; identical to SEQ ID NO: 2054
  Description of Artificial Sequence: Synthetic peptide
  MOD_RES (16)..(16): hLys
  c-term amidation

SEQ ID NO: 2188 - protein, 38 aa, Artificial Sequence; identical to SEQ ID NO: 2054
  Description of Artificial Sequence: Synthetic peptide
  MOD_RES (16)..(16): hArg
  c-term amidation

SEQ ID NO: 2189 - protein, 38 aa, Artificial Sequence; identical to SEQ ID NO: 2054
  Description of Artificial Sequence: Synthetic peptide
  MOD_RES (16)..(16): Cit
  c-term amidation

SEQ ID NO: 2190 - protein, 38 aa, Artificial Sequence; identical to SEQ ID NO: 2054
  Description of Artificial Sequence: Synthetic peptide
  MOD_RES (16)..(16): hCit
  c-term amidation

SEQ ID NO: 2191 - protein, 38 aa, Artificial Sequence; identical to SEQ ID NO: 2054
  Description of Artificial Sequence: Synthetic peptide
  MOD_RES (16)..(16): Dpr
  c-term amidation

SEQ ID NO: 2192 - protein, 38 aa, Artificial Sequence; identical to SEQ ID NO: 2054
  Description of Artificial Sequence: Synthetic peptide
  MOD_RES (16)..(16): Dab
  c-term amidation

SEQ ID NO: 2193 - protein, 38 aa, Artificial Sequence; identical to SEQ ID NO: 2060
  Description of Artificial Sequence: Synthetic peptide
  MOD_RES (16)..(16): Orn
  c-term amidation

SEQ ID NO: 2194 - protein, 38 aa, Artificial Sequence; identical to SEQ ID NO: 2060
  Description of Artificial Sequence: Synthetic peptide
  MOD_RES (16)..(16): hLys
  c-term amidation

SEQ ID NO: 2195 - protein, 38 aa, Artificial Sequence; identical to SEQ ID NO: 2060
  Description of Artificial Sequence: Synthetic peptide
  MOD_RES (16)..(16): hArg
  c-term amidation

SEQ ID NO: 2196 - protein, 38 aa, Artificial Sequence; identical to SEQ ID NO: 2060
  Description of Artificial Sequence: Synthetic peptide
  MOD_RES (16)..(16): Cit
  c-term amidation

SEQ ID NO: 2197 - protein, 38 aa, Artificial Sequence; identical to SEQ ID NO: 2060
  Description of Artificial Sequence: Synthetic peptide
  MOD_RES (16)..(16): hCit
  c-term amidation

SEQ ID NO: 2198 - protein, 38 aa, Artificial Sequence; identical to SEQ ID NO: 2060
  Description of Artificial Sequence: Synthetic peptide
  MOD_RES (16)..(16): Dpr
  c-term amidation

SEQ ID NO: 2199 - protein, 38 aa, Artificial Sequence; identical to SEQ ID NO: 2060
  Description of Artificial Sequence: Synthetic peptide
  MOD_RES (16)..(16): Dab
  c-term amidation

SEQ ID NO: 2200 - protein, 38 aa, Artificial Sequence; identical to SEQ ID NO: 2067
  Description of Artificial Sequence: Synthetic peptide
  MOD_RES (16)..(16): Orn
  c-term amidation

SEQ ID NO: 2201 - protein, 38 aa, Artificial Sequence; identical to SEQ ID NO: 2067
  Description of Artificial Sequence: Synthetic peptide
  MOD_RES (16)..(16): hLys
  c-term amidation

SEQ ID NO: 2202 - protein, 38 aa, Artificial Sequence; identical to SEQ ID NO: 2067
  Description of Artificial Sequence: Synthetic peptide
  MOD_RES (16)..(16): hArg
  c-term amidation

SEQ ID NO: 2203 - protein, 38 aa, Artificial Sequence; identical to SEQ ID NO: 2067
  Description of Artificial Sequence: Synthetic peptide
  MOD_RES (16)..(16): Cit
  c-term amidation

SEQ ID NO: 2204 - protein, 38 aa, Artificial Sequence; identical to SEQ ID NO: 2067
  Description of Artificial Sequence: Synthetic peptide
  MOD_RES (16)..(16): hCit
  c-term amidation

SEQ ID NO: 2205 - protein, 38 aa, Artificial Sequence; identical to SEQ ID NO: 2067
  Description of Artificial Sequence: Synthetic peptide
  MOD_RES (16)..(16): Dpr
  c-term amidation

SEQ ID NO: 2206 - protein, 38 aa, Artificial Sequence; identical to SEQ ID NO: 2067
  Description of Artificial Sequence: Synthetic peptide
  MOD_RES (16)..(16): Dab
  c-term amidation

SEQ ID NO: 2207 - protein, 35 aa, Artificial Sequence; identical to SEQ ID NO: 2074
  Description of Artificial Sequence: Synthetic peptide
  MOD_RES (16)..(16): Orn
  c-term amidation

SEQ ID NO: 2208 - protein, 35 aa, Artificial Sequence; identical to SEQ ID NO: 2074
  Description of Artificial Sequence: Synthetic peptide
  MOD_RES (16)..(16): hLys
  c-term amidation

SEQ ID NO: 2209 - protein, 35 aa, Artificial Sequence; identical to SEQ ID NO: 2074
  Description of Artificial Sequence: Synthetic peptide
  MOD_RES (16)..(16): hArg
  c-term amidation

SEQ ID NO: 2210 - protein, 35 aa, Artificial Sequence; identical to SEQ ID NO: 2074
  Description of Artificial Sequence: Synthetic peptide
  MOD_RES (16)..(16): Cit
  c-term amidation

SEQ ID NO: 2211 - protein, 35 aa, Artificial Sequence; identical to SEQ ID NO: 2074
  Description of Artificial Sequence: Synthetic peptide
  MOD_RES (16)..(16): hCit
  c-term amidation

SEQ ID NO: 2212 - protein, 35 aa, Artificial Sequence; identical to SEQ ID NO: 2074
  Description of Artificial Sequence: Synthetic peptide
  MOD_RES (16)..(16): Dpr
  c-term amidation

SEQ ID NO: 2213 - protein, 33 aa, Artificial Sequence
  Description of Artificial Sequence: Synthetic peptide
  MOD_RES (16)..(16): Orn
  c-term amidation
GVIINVKCKISAQCLXPCKEAGMRFGKCMNGKC

SEQ ID NO: 2214 - protein, 33 aa, Artificial Sequence; identical to SEQ ID NO: 2213
  Description of Artificial Sequence: Synthetic peptide
  MOD_RES (16)..(16): hLys
  c-term amidation

SEQ ID NO: 2215 - protein, 33 aa, Artificial Sequence; identical to SEQ ID NO: 2213
  Description of Artificial Sequence: Synthetic peptide
  MOD_RES (16)..(16): hArg
  c-term amidation

SEQ ID NO: 2216 - protein, 33 aa, Artificial Sequence; identical to SEQ ID NO: 2213
  Description of Artificial Sequence: Synthetic peptide
  MOD_RES (16)..(16): Cit
  c-term amidation

SEQ ID NO: 2217 - protein, 35 aa, Artificial Sequence; identical to SEQ ID NO: 2074
  Description of Artificial Sequence: Synthetic peptide
  MOD_RES (16)..(16): hCit
  c-term amidation

SEQ ID NO: 2218 - protein, 33 aa, Artificial Sequence; identical to SEQ ID NO: 2213
  Description of Artificial Sequence: Synthetic peptide
  MOD_RES (16)..(16): Dpr
  c-term amidation

SEQ ID NO: 2219 - protein, 33 aa, Artificial Sequence; identical to SEQ ID NO: 2213
  Description of Artificial Sequence: Synthetic peptide
  MOD_RES (16)..(16): Dab
  c-term amidation

SEQ ID NO: 2220 - protein, 38 aa, Artificial Sequence
  Description of Artificial Sequence: Synthetic peptide
  c-term amidation
GVIINVKCKISAQCLKPCKEAGMRFGKCMNGKCHCWGG

SEQ ID NO: 2221 - protein, 38 aa, Artificial Sequence; identical to SEQ ID NO: 2088
  Description of Artificial Sequence: Synthetic peptide
  MOD_RES (16)..(16): Orn
  c-term amidation

SEQ ID NO: 2222 - protein, 38 aa, Artificial Sequence; identical to SEQ ID NO: 2088
  Description of Artificial Sequence: Synthetic peptide
  MOD_RES (16)..(16): hLys
  c-term amidation

SEQ ID NO: 2223 - protein, 38 aa, Artificial Sequence; identical to SEQ ID NO: 2088
  Description of Artificial Sequence: Synthetic peptide
  MOD_RES (16)..(16): hArg
  c-term amidation

SEQ ID NO: 2224 - protein, 38 aa, Artificial Sequence; identical to SEQ ID NO: 2088
  Description of Artificial Sequence: Synthetic peptide
  MOD_RES (16)..(16): Cit
  c-term amidation

SEQ ID NO: 2225 - protein, 38 aa, Artificial Sequence; identical to SEQ ID NO: 2088
  Description of Artificial Sequence: Synthetic peptide
  MOD_RES (16)..(16): hCit
  c-term amidation

SEQ ID NO: 2226 - protein, 38 aa, Artificial Sequence; identical to SEQ ID NO: 2088
  Description of Artificial Sequence: Synthetic peptide
  MOD_RES (16)..(16): Dpr
  c-term amidation

SEQ ID NO: 2227 - protein, 38 aa, Artificial Sequence; identical to SEQ ID NO: 2088
  Description of Artificial Sequence: Synthetic peptide
  MOD_RES (16)..(16): Dab
  c-term amidation

SEQ ID NO: 2228 - protein, 38 aa, Artificial Sequence
  Description of Artificial Sequence: Synthetic peptide
  c-term amidation
GVIINVKCKISAQCLKPCKEAGMRFGKCMNGKCACYGG

SEQ ID NO: 2229 - protein, 38 aa, Artificial Sequence; identical to SEQ ID NO: 2098
  Description of Artificial Sequence: Synthetic peptide
  MOD_RES (16)..(16): Orn
  c-term amidation

SEQ ID NO: 2230 - protein, 38 aa, Artificial Sequence; identical to SEQ ID NO: 2098
  Description of Artificial Sequence: Synthetic peptide
  MOD_RES (16)..(16): hLys
  c-term amidation

SEQ ID NO: 2231 - protein, 38 aa, Artificial Sequence; identical to SEQ ID NO: 2098
  Description of Artificial Sequence: Synthetic peptide
  MOD_RES (16)..(16): hArg
  c-term amidation

SEQ ID NO: 2232 - protein, 38 aa, Artificial Sequence; identical to SEQ ID NO: 2098
  Description of Artificial Sequence: Synthetic peptide
  MOD_RES (16)..(16): Cit
  c-term amidation

SEQ ID NO: 2233 - protein, 38 aa, Artificial Sequence; identical to SEQ ID NO: 2088
  Description of Artificial Sequence: Synthetic peptide
  MOD_RES (16)..(16): hCit
  c-term amidation

SEQ ID NO: 2234 - protein, 38 aa, Artificial Sequence; identical to SEQ ID NO: 2098
  Description of Artificial Sequence: Synthetic peptide
  MOD_RES (16)..(16): Dpr
  c-term amidation

SEQ ID NO: 2235 - protein, 38 aa, Artificial Sequence; identical to SEQ ID NO: 2098
  Description of Artificial Sequence: Synthetic peptide
  MOD_RES (16)..(16): Dab
  c-term amidation

SEQ ID NO: 2236 - protein, 38 aa, Artificial Sequence; identical to SEQ ID NO: 2106
  Description of Artificial Sequence: Synthetic peptide
  MOD_RES (16)..(16): Orn
  c-term amidation

SEQ ID NO: 2237 - protein, 38 aa, Artificial Sequence; identical to SEQ ID NO: 2106
  Description of Artificial Sequence: Synthetic peptide
  MOD_RES (16)..(16): hLys
  c-term amidation

SEQ ID NO: 2238 - protein, 38 aa, Artificial Sequence; identical to SEQ ID NO: 2106
  Description of Artificial Sequence: Synthetic peptide
  MOD_RES (16)..(16): hArg
  c-term amidation

SEQ ID NO: 2239 - protein, 38 aa, Artificial Sequence; identical to SEQ ID NO: 2106
  Description of Artificial Sequence: Synthetic peptide
  MOD_RES (16)..(16): Cit
  c-term amidation

SEQ ID NO: 2240 - protein, 38 aa, Artificial Sequence; identical to SEQ ID NO: 2106
  Description of Artificial Sequence: Synthetic peptide
  MOD_RES (16)..(16): hCit
  c-term amidation

SEQ ID NO: 2241 - protein, 38 aa, Artificial Sequence; identical to SEQ ID NO: 2106
  Description of Artificial Sequence: Synthetic peptide
  MOD_RES (16)..(16): Dpr
  c-term amidation

SEQ ID NO: 2242 - protein, 38 aa, Artificial Sequence; identical to SEQ ID NO: 2112
  Description of Artificial Sequence: Synthetic peptide
  MOD_RES (16)..(16): Orn
  c-term amidation

SEQ ID NO: 2243 - protein, 38 aa, Artificial Sequence; identical to SEQ ID NO: 2112
  Description of Artificial Sequence: Synthetic peptide
  MOD_RES (16)..(16): hLys
  c-term amidation

SEQ ID NO: 2244 - protein, 38 aa, Artificial Sequence; identical to SEQ ID NO: 2112
  Description of Artificial Sequence: Synthetic peptide
  MOD_RES (16)..(16): hArg
  c-term amidation

SEQ ID NO: 2245 - protein, 38 aa, Artificial Sequence; identical to SEQ ID NO: 2112
  Description of Artificial Sequence: Synthetic peptide
  MOD_RES (16)..(16): Cit
  c-term amidation

SEQ ID NO: 2246 - protein, 37 aa, Artificial Sequence; identical to SEQ ID NO: 2116
  Description of Artificial Sequence: Synthetic peptide
  MOD_RES (16)..(16): hCit
  c-term amidation

SEQ ID NO: 2247 - protein, 38 aa, Artificial Sequence; identical to SEQ ID NO: 2112
  Description of Artificial Sequence: Synthetic peptide
  MOD_RES (16)..(16): Dpr
  c-term amidation

SEQ ID NO: 2248 - protein, 38 aa, Artificial Sequence; identical to SEQ ID NO: 2112
  Description of Artificial Sequence: Synthetic peptide
  MOD_RES (16)..(16): Dab
  c-term amidation

SEQ ID NO: 2249 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCMNGKCACYGG

SEQ ID NO: 2250 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCMNGKCACGGG

SEQ ID NO: 2251 - protein, 36 aa, Artificial Sequence
  Description of Artificial Sequence: Synthetic peptide
  MOD_RES (20)..(20): Cpa
  c-term amidation
GVIINVKCKISAQCLKPCKXAGMRFGKCMNGKCACY

SEQ ID NO: 2252 - protein, 38 aa, Artificial Sequence; identical to SEQ ID NO: 2028
  Description of Artificial Sequence: Synthetic peptide
  n-term acetylation
  c-term amidation

SEQ ID NO: 2253 - protein, 38 aa, Artificial Sequence; identical to SEQ ID NO: 2249
  Description of Artificial Sequence: Synthetic peptide
  MOD_RES (20)..(20): Aad
  c-term amidation

SEQ ID NO: 2254 - protein, 38 aa, Artificial Sequence
  Description of Artificial Sequence: Synthetic peptide
  MOD_RES (20)..(20): Aad
  c-term amidation
GVIINVKCKISAQCLKPCKXAGMRFGKCMNGKCHCYGG

SEQ ID NO: 2255 - protein, 38 aa, Artificial Sequence; identical to SEQ ID NO: 2249
  Description of Artificial Sequence: Synthetic peptide
  MOD_RES (20)..(20): Aad

SEQ ID NO: 2256 - protein, 38 aa, Artificial Sequence
  Description of Artificial Sequence: Synthetic peptide
  c-term amidation
GVIINVKCKISAQCLHPCKDAGMRFGKCMNGKCACYGG

SEQ ID NO: 2257 - protein, 38 aa, Artificial Sequence; identical to SEQ ID NO: 2256
  Description of Artificial Sequence: Synthetic peptide

SEQ ID NO: 2258 - protein, 36 aa, Artificial Sequence
  Description of Artificial Sequence: Synthetic peptide
  c-term amidation
GVIINVKCKISAQCLHPCKDAGMRFGKCMNGKCACY

SEQ ID NO: 2259 - protein, 38 aa, Artificial Sequence
  Description of Artificial Sequence: Synthetic peptide
  c-term amidation
GVIINVKCKISAQCLHPCKDAGMRFGKCMNGKCHCYGG

SEQ ID NO: 2260 - protein, 38 aa, Artificial Sequence; identical to SEQ ID NO: 2259
  Description of Artificial Sequence: Synthetic peptide

SEQ ID NO: 2261 - protein, 38 aa, Artificial Sequence
  Description of Artificial Sequence: Synthetic peptide
GVIINVKCKISAQCLHPCKDAGMRFGKCMNGKCHCYPK

SEQ ID NO: 2262 - protein, 35 aa, Artificial Sequence
  Description of Artificial Sequence: Synthetic peptide
GVIINVKCKISAQCLHPCKDAGMRFGKCMNGKCAC

SEQ ID NO: 2263 - protein, 38 aa, Artificial Sequence
  Description of Artificial Sequence: Synthetic peptide
  MOD_RES (36)..(36): 1-Nal
  c-term amidation
GVIINVKCKISAQCLKPCKDAGMRFGKCMNGKCACXGG

SEQ ID NO: 2264 - protein, 38 aa, Artificial Sequence
  Description of Artificial Sequence: Synthetic peptide
  MOD_RES (36)..(36): 1-Nal
  c-term amidation
GVIINVKCKISAQCLKPCKDAGMRFGKCMNGKCACXPK

SEQ ID NO: 2265 - protein, 38 aa, Artificial Sequence; identical to SEQ ID NO: 2263
  Description of Artificial Sequence: Synthetic peptide
  MOD_RES (36)..(36): 2-Nal
  c-term amidation

SEQ ID NO: 2266 - protein, 38 aa, Artificial Sequence; identical to SEQ ID NO: 2263
  Description of Artificial Sequence: Synthetic peptide
  MOD_RES (36)..(36): Cha
  c-term amidation

SEQ ID NO: 2267 - protein, 38 aa, Artificial Sequence; identical to SEQ ID NO: 2263
  Description of Artificial Sequence: Synthetic peptide
  MOD_RES (36)..(36): MePhe
  c-term amidation

SEQ ID NO: 2268 - protein, 38 aa, Artificial Sequence; identical to SEQ ID NO: 2263
  Description of Artificial Sequence: Synthetic peptide
  MOD_RES (36)..(36): BiPha
  c-term amidation

SEQ ID NO: 2269 - protein, 38 aa, Artificial Sequence
  Description of Artificial Sequence: Synthetic peptide
  MOD_RES (34)..(34): Aib
  c-term amidation
GVIINVKCKISAQCLKPCKDAGMRFGKCMNGKCXCYGG

SEQ ID NO: 2270 - protein, 38 aa, Artificial Sequence; identical to SEQ ID NO: 2269
  Description of Artificial Sequence: Synthetic peptide
  MOD_RES (34)..(34): Abu
  c-term amidation

SEQ ID NO: 2271 - protein, 36 aa, Artificial Sequence
  Description of Artificial Sequence: Synthetic peptide
  MOD_RES (36)..(36): 1-Nal
GVIINVKCKISAQCLKPCKDAGMRFGKCMNGKCACX

SEQ ID NO: 2272 - protein, 38 aa, Artificial Sequence
  Description of Artificial Sequence: Synthetic peptide
  MOD_RES (36)..(36): 1-Nal
  c-term amidation
GVIINVKCKISAQCLHPCKDAGMRFGKCMNGKCACXGG

SEQ ID NO: 2273 - protein, 36 aa, Artificial Sequence; identical to SEQ ID NO: 2271
  Description of Artificial Sequence: Synthetic peptide
  MOD_RES (36)..(36): 4Bip
  c-term amidation

SEQ ID NO: 2274 - protein, 38 aa, Artificial Sequence; identical to SEQ ID NO: 2272
  Description of Artificial Sequence: Synthetic peptide
  MOD_RES (36)..(36): 4Bip
  c-term amidation

SEQ ID NO: 2275 - protein, 38 aa, Artificial Sequence
  Description of Artificial Sequence: Synthetic peptide
GVIINVKCKISAQCLKPCKDAGMRFGKCMNGKCHCGGG

SEQ ID NO: 2276 - protein, 38 aa, Artificial Sequence
  Description of Artificial Sequence: Synthetic peptide
GVIINVKCKISAQCLEPCKKAGMRFGACMNGKCHCTPK

SEQ ID NO: 2277 - protein, 38 aa, Artificial Sequence
  Description of Artificial Sequence: Synthetic peptide
GVIINVSCKISAQCLEPCKKAGMRFGACMNGKCHCTPK

SEQ ID NO: 2278 - protein, 38 aa, Artificial Sequence
  Description of Artificial Sequence: Synthetic peptide
GVIINVKCKISAQCLKPCKKAGMRFGACMNGKCHCTPK

SEQ ID NO: 2279 - protein, 38 aa, Artificial Sequence
  Description of Artificial Sequence: Synthetic peptide
GVIINVKCKISAQCLEPCKDAGMRFGACMNGKCHCTPK

SEQ ID NO: 2280 - protein, 38 aa, Artificial Sequence
  Description of Artificial Sequence: Synthetic peptide
GVIINVKCKISAQCLKPCKDAGMRFGACMNGKCHCTPK

SEQ ID NO: 2281 - protein, 38 aa, Artificial Sequence
  Description of Artificial Sequence: Synthetic peptide
GVIINVSCKISAQCLKPCKDAGMRFGACMNGKCHCTPK

SEQ ID NO: 2282 - protein, 38 aa, Artificial Sequence
  Description of Artificial Sequence: Synthetic peptide
GVIINVKCKISPQCLKPCKDAGMRFGACMNGKCHCTPK

SEQ ID NO: 2283 - protein, 38 aa, Artificial Sequence
  Description of Artificial Sequence: Synthetic peptide
GVIINVKCKISAQCLKPCKDAGMRFGACMNGKCHCYPK

SEQ ID NO: 2284 - protein, 38 aa, Artificial Sequence; identical to SEQ ID NO: 2282
  Description of Artificial Sequence: Synthetic peptide
  n-term acetylation

SEQ ID NO: 2285 - protein, 38 aa, Artificial Sequence; identical to SEQ ID NO: 2282
  Description of Artificial Sequence: Synthetic peptide
  c-term amidation

SEQ ID NO: 2286 - protein, 38 aa, Artificial Sequence; identical to SEQ ID NO: 2282
  Description of Artificial Sequence: Synthetic peptide
  n-term acetylation
  c-term amidation

SEQ ID NO: 2287 - protein, 38 aa, Artificial Sequence; identical to SEQ ID NO: 2283
  Description of Artificial Sequence: Synthetic peptide
  c-term amidation

SEQ ID NO: 2288 - protein, 38 aa, Artificial Sequence; identical to SEQ ID NO: 2283
  Description of Artificial Sequence: Synthetic peptide
  n-term acetylation

SEQ ID NO: 2289 - protein, 38 aa, Artificial Sequence; identical to SEQ ID NO: 2283
  Description of Artificial Sequence: Synthetic peptide
  n-term acetylation
  c-term amidation

SEQ ID NO: 2290 - protein, 38 aa, Artificial Sequence; identical to SEQ ID NO: 2278
  Description of Artificial Sequence: Synthetic peptide
  c-term amidation

SEQ ID NO: 2291 - protein, 38 aa, Artificial Sequence; identical to SEQ ID NO: 2278
  Description of Artificial Sequence: Synthetic peptide
  n-term acetylation

SEQ ID NO: 2292 - protein, 38 aa, Artificial Sequence; identical to SEQ ID NO: 2278
  Description of Artificial Sequence: Synthetic peptide
  n-term acetylation
  c-term amidation

SEQ ID NO: 2293 - protein, 38 aa, Artificial Sequence; identical to SEQ ID NO: 2279
  Description of Artificial Sequence: Synthetic peptide
  n-term acetylation

SEQ ID NO: 2294 - protein, 38 aa, Artificial Sequence; identical to SEQ ID NO: 2279
  Description of Artificial Sequence: Synthetic peptide
  c-term amidation

SEQ ID NO: 2295 - protein, 38 aa, Artificial Sequence; identical to SEQ ID NO: 2279
  Description of Artificial Sequence: Synthetic peptide
  n-term acetylation
  c-term amidation

SEQ ID NO: 2296 - protein, 38 aa, Artificial Sequence; identical to SEQ ID NO: 2276
  Description of Artificial Sequence: Synthetic peptide
  c-term amidation

SEQ ID NO: 2297 - protein, 38 aa, Artificial Sequence; identical to SEQ ID NO: 2276
  Description of Artificial Sequence: Synthetic peptide
  n-term acetylation

SEQ ID NO: 2298 - protein, 38 aa, Artificial Sequence; identical to SEQ ID NO: 2276
  Description of Artificial Sequence: Synthetic peptide
  n-term acetylation
  c-term amidation

SEQ ID NO: 2299 - protein, 38 aa, Artificial Sequence; identical to SEQ ID NO: 2280
  Description of Artificial Sequence: Synthetic peptide
  c-term amidation

SEQ ID NO: 2300 - protein, 38 aa, Artificial Sequence; identical to SEQ ID NO: 2280
  Description of Artificial Sequence: Synthetic peptide
  n-term acetylation

SEQ ID NO: 2301 - protein, 38 aa, Artificial Sequence; identical to SEQ ID NO: 2280
  Description of Artificial Sequence: Synthetic peptide
  n-term acetylation
  c-term amidation

SEQ ID NO: 2302 - protein, 37 aa, Artificial Sequence
  Description of Artificial Sequence: Synthetic peptide
VIINVKCKISAQCLEPCKKAGMRFGACMNGKCHCTPK

SEQ ID NO: 2303 - protein, 37 aa, Artificial Sequence; identical to SEQ ID NO: 2302
  Description of Artificial Sequence: Synthetic peptide
  n-term acetylation

SEQ ID NO: 2304 - protein, 37 aa, Artificial Sequence; identical to SEQ ID NO: 2302
  Description of Artificial Sequence: Synthetic peptide
  c-term amidation

SEQ ID NO: 2305 - protein, 37 aa, Artificial Sequence; identical to SEQ ID NO: 2302
  Description of Artificial Sequence: Synthetic peptide
  n-term acetylation
  c-term amidation

SEQ ID NO: 2306 - protein, 38 aa, Artificial Sequence
  Description of Artificial Sequence: Synthetic peptide
GVIINVKCKISAQCLEPCKKAGMRFGACMNGKCACTPK

SEQ ID NO: 2307 - protein, 38 aa, Artificial Sequence; identical to SEQ ID NO: 2306
  Description of Artificial Sequence: Synthetic peptide
  n-term acetylation

SEQ ID NO: 2308 - protein, 38 aa, Artificial Sequence; identical to SEQ ID NO: 2306
  Description of Artificial Sequence: Synthetic peptide
  c-term amidation

SEQ ID NO: 2309 - protein, 38 aa, Artificial Sequence; identical to SEQ ID NO: 2306
  Description of Artificial Sequence: Synthetic peptide
  n-term acetylation
  c-term amidation

SEQ ID NO: 2310 - protein, 37 aa, Artificial Sequence
  Description of Artificial Sequence: Synthetic peptide
VIINVKCKISAQCLKPCKDAGMRFGACMNGKCHCTPK

SEQ ID NO: 2311 - protein, 37 aa, Artificial Sequence; identical to SEQ ID NO: 2310
  Description of Artificial Sequence: Synthetic peptide
  n-term acetylation

SEQ ID NO: 2312 - protein, 37 aa, Artificial Sequence; identical to SEQ ID NO: 2310
  Description of Artificial Sequence: Synthetic peptide
  c-term amidation

SEQ ID NO: 2313 - protein, 37 aa, Artificial Sequence; identical to SEQ ID NO: 2310
  Description of Artificial Sequence: Synthetic peptide
  n-term acetylation
  c-term amidation

SEQ ID NO: 2314 - protein, 34 aa, Artificial Sequence
  Description of Artificial Sequence: Synthetic peptide
NVKCKISAQCLKPCKDAGMRFGACMNGKCHCTPK

SEQ ID NO: 2315 - protein, 34 aa, Artificial Sequence; identical to SEQ ID NO: 2314
  Description of Artificial Sequence: Synthetic peptide
  n-term acetylation

SEQ ID NO: 2316 - protein, 34 aa, Artificial Sequence; identical to SEQ ID NO: 2314
  Description of Artificial Sequence: Synthetic peptide
  c-term amidation

SEQ ID NO: 2317 - protein, 34 aa, Artificial Sequence; identical to SEQ ID NO: 2314
  Description of Artificial Sequence: Synthetic peptide
  n-term acetylation
  c-term amidation

SEQ ID NO: 2318 - protein, 32 aa, Artificial Sequence
  Description of Artificial Sequence: Synthetic peptide
KCKISAQCLKPCKDAGMRFGACMNGKCHCTPK

SEQ ID NO: 2319 - protein, 32 aa, Artificial Sequence; identical to SEQ ID NO: 2318
  Description of Artificial Sequence: Synthetic peptide
  n-term acetylation

SEQ ID NO: 2320 - protein, 32 aa, Artificial Sequence; identical to SEQ ID NO: 2318
  Description of Artificial Sequence: Synthetic peptide
  c-term amidation

SEQ ID NO: 2321 - protein, 32 aa, Artificial Sequence; identical to SEQ ID NO: 2318
  Description of Artificial Sequence: Synthetic peptide
  n-term acetylation
  c-term amidation

SEQ ID NO: 2322 - protein, 31 aa, Artificial Sequence
  Description of Artificial Sequence: Synthetic peptide
CKISAQCLKPCKDAGMRFGACMNGKCHCTPK

SEQ ID NO: 2323 - protein, 31 aa, Artificial Sequence; identical to SEQ ID NO: 2322
  Description of Artificial Sequence: Synthetic peptide
  n-term acetylation

SEQ ID NO: 2324 - protein, 31 aa, Artificial Sequence; identical to SEQ ID NO: 2322
  Description of Artificial Sequence: Synthetic peptide
  c-term amidation

SEQ ID NO: 2325 - protein, 31 aa, Artificial Sequence; identical to SEQ ID NO: 2322
  Description of Artificial Sequence: Synthetic peptide
  n-term acetylation
  c-term amidation

SEQ ID NO: 2326 - protein, 38 aa, Artificial Sequence
  Description of Artificial Sequence: Synthetic peptide
GVIINVKCKISAQCLKPCKDAGMRNGACMNGKCHCTPK

SEQ ID NO: 2327 - protein, 38 aa, Artificial Sequence; identical to SEQ ID NO: 2326
  Description of Artificial Sequence: Synthetic peptide
  c-term amidation

SEQ ID NO: 2328 - protein, 38 aa, Artificial Sequence; identical to SEQ ID NO: 2326
  Description of Artificial Sequence: Synthetic peptide
  n-term acetylation

SEQ ID NO: 2329 - protein, 38 aa, Artificial Sequence; identical to SEQ ID NO: 2326
  Description of Artificial Sequence: Synthetic peptide
  n-term acetylation
  c-term amidation

SEQ ID NO: 2330 - protein, 38 aa, Artificial Sequence; identical to SEQ ID NO: 1952
  Description of Artificial Sequence: Synthetic peptide

SEQ ID NO: 2331 - protein, 38 aa, Artificial Sequence; identical to SEQ ID NO: 1952
  Description of Artificial Sequence: Synthetic peptide
  c-term amidation

SEQ ID NO: 2332 - protein, 38 aa, Artificial Sequence; identical to SEQ ID NO: 1952
  Description of Artificial Sequence: Synthetic peptide
  n-term acetylation

SEQ ID NO: 2333 - protein, 38 aa, Artificial Sequence; identical to SEQ ID NO: 1952
  Description of Artificial Sequence: Synthetic peptide
  n-term acetylation
  c-term amidation

SEQ ID NO: 2334 - protein, 38 aa, Artificial Sequence
  Description of Artificial Sequence: Synthetic peptide
GVIINVKCKISKQCLKPCRDAGMRFGACMNGKCHCTPK

SEQ ID NO: 2335 - protein, 38 aa, Artificial Sequence; identical to SEQ ID NO: 2334
  Description of Artificial Sequence: Synthetic peptide
  n-term acetylation

SEQ ID NO: 2336 - protein, 38 aa, Artificial Sequence; identical to SEQ ID NO: 2334
  Description of Artificial Sequence: Synthetic peptide
  c-term amidation

SEQ ID NO: 2337 - protein, 38 aa, Artificial Sequence; identical to SEQ ID NO: 2334
  Description of Artificial Sequence: Synthetic peptide
  n-term acetylation
  c-term amidation

SEQ ID NO: 2338 - protein, 37 aa, Artificial Sequence
  Description of Artificial Sequence: Synthetic peptide
TIINVKCKISAQCLKPCKDAGMRFGACMNGKCHCTPK

SEQ ID NO: 2339 - protein, 37 aa, Artificial Sequence; identical to SEQ ID NO: 2338
  Description of Artificial Sequence: Synthetic peptide
  n-term acetylation

SEQ ID NO: 2340 - protein, 37 aa, Artificial Sequence; identical to SEQ ID NO: 2338
  Description of Artificial Sequence: Synthetic peptide
  c-term amidation

SEQ ID NO: 2341 - protein, 37 aa, Artificial Sequence; identical to SEQ ID NO: 2338
  Description of Artificial Sequence: Synthetic peptide
  n-term acetylation
  c-term amidation

SEQ ID NO: 2342 - protein, 38 aa, Artificial Sequence
  Description of Artificial Sequence: Synthetic peptide
GVKINVKCKISAQCLEPCKKAGMRFGACMNGKCHCTPK

SEQ ID NO: 2343 - protein, 38 aa, Artificial Sequence; identical to SEQ ID NO: 2342
  Description of Artificial Sequence: Synthetic peptide
  n-term acetylation

SEQ ID NO: 2344 - protein, 38 aa, Artificial Sequence; identical to SEQ ID NO: 2342
  Description of Artificial Sequence: Synthetic peptide
  c-term amidation

SEQ ID NO: 2345 - protein, 38 aa, Artificial Sequence; identical to SEQ ID NO: 2342
  Description of Artificial Sequence: Synthetic peptide
  n-term acetylation
  c-term amidation

SEQ ID NO: 2346 - protein, 38 aa, Artificial Sequence
  Description of Artificial Sequence: Synthetic peptide
GVKINVKCKISAQCLEPCKKAGMRFGACMNGKCACTPK

SEQ ID NO: 2347 - protein, 38 aa, Artificial Sequence
  Description of Artificial Sequence: Synthetic peptide
GVKINVKCKISAQCLKPCKDAGMRFGACMNGKCHCTPK

SEQ ID NO: 2348 - protein, 38 aa, Artificial Sequence
  Description of Artificial Sequence: Synthetic peptide
GVKINVKCKISAQCLKPCKDAGMRFGACMNGKCACTPK

SEQ ID NO: 2349 - protein, 38 aa, Artificial Sequence; identical to SEQ ID NO: 2346
  Description of Artificial Sequence: Synthetic peptide
  n-term acetylation

SEQ ID NO: 2350 - protein, 38 aa, Artificial Sequence; identical to SEQ ID NO: 2346
  Description of Artificial Sequence: Synthetic peptide
  c-term amidation

SEQ ID NO: 2351 - protein, 38 aa, Artificial Sequence; identical to SEQ ID NO: 2346
  Description of Artificial Sequence: Synthetic peptide
  n-term acetylation
  c-term amidation

SEQ ID NO: 2352 - protein, 38 aa, Artificial Sequence; identical to SEQ ID NO: 2348
  Description of Artificial Sequence: Synthetic peptide
  n-term acetylation

SEQ ID NO: 2353 - protein, 38 aa, Artificial Sequence; identical to SEQ ID NO: 2348
  Description of Artificial Sequence: Synthetic peptide
  c-term amidation

SEQ ID NO: 2354 - protein, 38 aa, Artificial Sequence; identical to SEQ ID NO: 2348
  Description of Artificial Sequence: Synthetic peptide
  n-term acetylation
  c-term amidation

SEQ ID NO: 2355 - protein, 38 aa, Artificial Sequence; identical to SEQ ID NO: 2347
  Description of Artificial Sequence: Synthetic peptide
  n-term acetylation

SEQ ID NO: 2356 - protein, 38 aa, Artificial Sequence; identical to SEQ ID NO: 2347
  Description of Artificial Sequence: Synthetic peptide
  c-term amidation

SEQ ID NO: 2357 - protein, 38 aa, Artificial Sequence; identical to SEQ ID NO: 2347
  Description of Artificial Sequence: Synthetic peptide
  n-term acetylation
  c-term amidation

SEQ ID NO: 2358 - protein, 36 aa, Artificial Sequence
  Description of Artificial Sequence: Synthetic peptide
GVIINVKCKISAQCLKPCKDAGMRFGACMNGKCHCT

SEQ ID NO: 2359 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCHCTPK

SEQ ID NO: 2360 - protein, 38 aa, Artificial Sequence; identical to SEQ ID NO: 2359
  Description of Artificial Sequence: Synthetic peptide
  MOD_RES (16)..(16): hLys

SEQ ID NO: 2361 - protein, 38 aa, Artificial Sequence; identical to SEQ ID NO: 2359
  Description of Artificial Sequence: Synthetic peptide
  MOD_RES (16)..(16): hArg

SEQ ID NO: 2362 - protein, 38 aa, Artificial Sequence; identical to SEQ ID NO: 2359
  Description of Artificial Sequence: Synthetic peptide
  MOD_RES (16)..(16): Cit

SEQ ID NO: 2363 - protein, 38 aa, Artificial Sequence; identical to SEQ ID NO: 2359
  Description of Artificial Sequence: Synthetic peptide
  MOD_RES (16)..(16): hCit

SEQ ID NO: 2364 - protein, 38 aa, Artificial Sequence; identical to SEQ ID NO: 2359
  Description of Artificial Sequence: Synthetic peptide
  MOD_RES (16)..(16): Dpr

SEQ ID NO: 2365 - protein, 38 aa, Artificial Sequence; identical to SEQ ID NO: 2359
  Description of Artificial Sequence: Synthetic peptide
  MOD_RES (16)..(16): Dab

SEQ ID NO: 2366 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCHCYPK

SEQ ID NO: 2367 - protein, 38 aa, Artificial Sequence; identical to SEQ ID NO: 2366
  Description of Artificial Sequence: Synthetic peptide
  MOD_RES (16)..(16): hLys

SEQ ID NO: 2368 - protein, 38 aa, Artificial Sequence; identical to SEQ ID NO: 2366
  Description of Artificial Sequence: Synthetic peptide
  MOD_RES (16)..(16): hArg

SEQ ID NO: 2369 - protein, 38 aa, Artificial Sequence; identical to SEQ ID NO: 2366
  Description of Artificial Sequence: Synthetic peptide
  MOD_RES (16)..(16): Cit

SEQ ID NO: 2370 - protein, 38 aa, Artificial Sequence; identical to SEQ ID NO: 2366
  Description of Artificial Sequence: Synthetic peptide
  MOD_RES (16)..(16): hCit

SEQ ID NO: 2371 - protein, 38 aa, Artificial Sequence; identical to SEQ ID NO: 2366
  Description of Artificial Sequence: Synthetic peptide
  MOD_RES (16)..(16): Dpr

SEQ ID NO: 2372 - protein, 38 aa, Artificial Sequence; identical to SEQ ID NO: 2366
  Description of Artificial Sequence: Synthetic peptide
  MOD_RES (16)..(16): Dab

SEQ ID NO: 2373 - protein, 38 aa, Artificial Sequence
  Description of Artificial Sequence: Synthetic peptide
GVIINVKCKISAQCLKPCKDAGMRFGACMNGKCACYPK

SEQ ID NO: 2374 - protein, 38 aa, Artificial Sequence
  Description of Artificial Sequence: Synthetic peptide
GVIINVKCKISAQCLKPCKDAGMRFGACMNGKCGCYPK

SEQ ID NO: 2375 - protein, 38 aa, Artificial Sequence
  Description of Artificial Sequence: Synthetic peptide
GVIINVKCKISAQCLKPCKDAGMRFGACMNGKCACFPK

SEQ ID NO: 2376 - protein, 38 aa, Artificial Sequence
  Description of Artificial Sequence: Synthetic peptide
GVIINVKCKISAQCLKPCKDAGMRFGACMNGKCACWPK

SEQ ID NO: 2377 - protein, 38 aa, Artificial Sequence
  Description of Artificial Sequence: Synthetic peptide
GVIINVKCKISAQCLKPCKEAGMRFGACMNGKCACYPK

SEQ ID NO: 2378 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCACTPK

SEQ ID NO: 2379 - protein, 38 aa, Artificial Sequence; identical to SEQ ID NO: 2378
  Description of Artificial Sequence: Synthetic peptide
  MOD_RES (16)..(16): hLys

SEQ ID NO: 2380 - protein, 38 aa, Artificial Sequence; identical to SEQ ID NO: 2378
  Description of Artificial Sequence: Synthetic peptide
  MOD_RES (16)..(16): hArg

SEQ ID NO: 2381 - protein, 38 aa, Artificial Sequence; identical to SEQ ID NO: 2378
  Description of Artificial Sequence: Synthetic peptide
  MOD_RES (16)..(16): Cit

SEQ ID NO: 2382 - protein, 38 aa, Artificial Sequence; identical to SEQ ID NO: 2359
  Description of Artificial Sequence: Synthetic peptide
  MOD_RES (16)..(16): hCit

SEQ ID NO: 2383 - protein, 38 aa, Artificial Sequence; identical to SEQ ID NO: 2378
  Description of Artificial Sequence: Synthetic peptide
  MOD_RES (16)..(16): Dpr

SEQ ID NO: 2384 - protein, 38 aa, Artificial Sequence; identical to SEQ ID NO: 2378
  Description of Artificial Sequence: Synthetic peptide
  MOD_RES (16)..(16): Dab

SEQ ID NO: 2385 - protein, 35 aa, Artificial Sequence
  Description of Artificial Sequence: Synthetic peptide
  MOD_RES (16)..(16): Orn
GVIINVKCKISAQCLXPCKDAGMRFGACMNGKCHC

SEQ ID NO: 2386 - protein, 35 aa, Artificial Sequence; identical to SEQ ID NO: 2385
  Description of Artificial Sequence: Synthetic peptide
  MOD_RES (16)..(16): hLys

SEQ ID NO: 2387 - protein, 35 aa, Artificial Sequence; identical to SEQ ID NO: 2385
  Description of Artificial Sequence: Synthetic peptide
  MOD_RES (16)..(16): hArg

SEQ ID NO: 2388 - protein, 35 aa, Artificial Sequence; identical to SEQ ID NO: 2385
  Description of Artificial Sequence: Synthetic peptide
  MOD_RES (16)..(16): Cit

SEQ ID NO: 2389 - protein, 35 aa, Artificial Sequence; identical to SEQ ID NO: 2385
  Description of Artificial Sequence: Synthetic peptide
  MOD_RES (16)..(16): hCit

SEQ ID NO: 2390 - protein, 35 aa, Artificial Sequence; identical to SEQ ID NO: 2385
  Description of Artificial Sequence: Synthetic peptide
  MOD_RES (16)..(16): Dpr

SEQ ID NO: 2391 - protein, 35 aa, Artificial Sequence; identical to SEQ ID NO: 2385
  Description of Artificial Sequence: Synthetic peptide
  MOD_RES (16)..(16): Dab

SEQ ID NO: 2392 - protein, 35 aa, Artificial Sequence
  Description of Artificial Sequence: Synthetic peptide
  MOD_RES (16)..(16): Orn
GVIINVKCKISAQCLXPCKDAGMRFGACMNGKCAC

SEQ ID NO: 2393 - protein, 35 aa, Artificial Sequence; identical to SEQ ID NO: 2392
  Description of Artificial Sequence: Synthetic peptide
  MOD_RES (16)..(16): hLys

SEQ ID NO: 2394 - protein, 35 aa, Artificial Sequence; identical to SEQ ID NO: 2392
  Description of Artificial Sequence: Synthetic peptide
  MOD_RES (16)..(16): hArg

SEQ ID NO: 2395 - protein, 35 aa, Artificial Sequence; identical to SEQ ID NO: 2392
  Description of Artificial Sequence: Synthetic peptide
  MOD_RES (16)..(16): Cit

SEQ ID NO: 2396 - protein, 35 aa, Artificial Sequence; identical to SEQ ID NO: 2385
  Description of Artificial Sequence: Synthetic peptide
  MOD_RES (16)..(16): hCit

SEQ ID NO: 2397 - protein, 35 aa, Artificial Sequence; identical to SEQ ID NO: 2392
  Description of Artificial Sequence: Synthetic peptide
  MOD_RES (16)..(16): Dpr

SEQ ID NO: 2398 - protein, 35 aa, Artificial Sequence; identical to SEQ ID NO: 2392
  Description of Artificial Sequence: Synthetic peptide
  MOD_RES (16)..(16): Dab

SEQ ID NO: 2399 - protein, 38 aa, Artificial Sequence
  Description of Artificial Sequence: Synthetic peptide
GVIINVKCKISAQCLKPCKDAGMRFGACMNGKCGCYGG

SEQ ID NO: 2400 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCHCYGG

SEQ ID NO: 2401 - protein, 38 aa, Artificial Sequence; identical to SEQ ID NO: 2400
  Description of Artificial Sequence: Synthetic peptide
  MOD_RES (16)..(16): hLys

SEQ ID NO: 2402 - protein, 38 aa, Artificial Sequence; identical to SEQ ID NO: 2400
  Description of Artificial Sequence: Synthetic peptide
  MOD_RES (16)..(16): hArg

SEQ ID NO: 2403 - protein, 38 aa, Artificial Sequence; identical to SEQ ID NO: 2400
  Description of Artificial Sequence: Synthetic peptide
  MOD_RES (16)..(16): Cit

SEQ ID NO: 2404 - protein, 38 aa, Artificial Sequence; identical to SEQ ID NO: 2400
  Description of Artificial Sequence: Synthetic peptide
  MOD_RES (16)..(16): hCit

SEQ ID NO: 2405 - protein, 38 aa, Artificial Sequence; identical to SEQ ID NO: 2400
  Description of Artificial Sequence: Synthetic peptide
  MOD_RES (16)..(16): Dpr

SEQ ID NO: 2406 - protein, 38 aa, Artificial Sequence
  Description of Artificial Sequence: Synthetic peptide
GVIINVKCKISAQCLKPCKDAGMRFGACMNGKCACYGG

SEQ ID NO: 2407 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCACYGG

SEQ ID NO: 2408 - protein, 38 aa, Artificial Sequence; identical to SEQ ID NO: 2407
  Description of Artificial Sequence: Synthetic peptide
  MOD_RES (16)..(16): hLys

SEQ ID NO: 2409 - protein, 38 aa, Artificial Sequence; identical to SEQ ID NO: 2407
  Description of Artificial Sequence: Synthetic peptide
  MOD_RES (16)..(16): hArg

SEQ ID NO: 2410 - protein, 38 aa, Artificial Sequence; identical to SEQ ID NO: 2407
  Description of Artificial Sequence: Synthetic peptide
  MOD_RES (16)..(16): Cit

SEQ ID NO: 2411 - protein, 38 aa, Artificial Sequence; identical to SEQ ID NO: 2400
  Description of Artificial Sequence: Synthetic peptide
  MOD_RES (16)..(16): hCit

SEQ ID NO: 2412 - protein, 38 aa, Artificial Sequence; identical to SEQ ID NO: 2407
  Description of Artificial Sequence: Synthetic peptide
  MOD_RES (16)..(16): Dpr

SEQ ID NO: 2413 - protein, 38 aa, Artificial Sequence; identical to SEQ ID NO: 2407
  Description of Artificial Sequence: Synthetic peptide
  MOD_RES (16)..(16): Dab

SEQ ID NO: 2414 - skipped

SEQ ID NO: 2415 - protein, 37 aa, Artificial Sequence
  Description of Artificial Sequence: Synthetic peptide
GVIINVKCKISAQCLKPCKDAGMRFGACMNGKCACYG

SEQ ID NO: 2416 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCHCGGG

SEQ ID NO: 2417 - protein, 38 aa, Artificial Sequence; identical to SEQ ID NO: 2416
  Description of Artificial Sequence: Synthetic peptide
  MOD_RES (16)..(16): hLys

SEQ ID NO: 2418 - protein, 38 aa, Artificial Sequence; identical to SEQ ID NO: 2416
  Description of Artificial Sequence: Synthetic peptide
  MOD_RES (16)..(16): hArg

SEQ ID NO: 2419 - protein, 38 aa, Artificial Sequence; identical to SEQ ID NO: 2416
  Description of Artificial Sequence: Synthetic peptide
  MOD_RES (16)..(16): Cit

SEQ ID NO: 2420 - protein, 38 aa, Artificial Sequence; identical to SEQ ID NO: 2416
  Description of Artificial Sequence: Synthetic peptide
  MOD_RES (16)..(16): hCit

SEQ ID NO: 2421 - protein, 38 aa, Artificial Sequence; identical to SEQ ID NO: 2416
  Description of Artificial Sequence: Synthetic peptide
  MOD_RES (16)..(16): Dpr

SEQ ID NO: 2422 - protein, 38 aa, Artificial Sequence
  Description of Artificial Sequence: Synthetic peptide
GVIINVKCKISAQCLKPCKDAGMRFGACMNGKCACFGG

SEQ ID NO: 2423 - protein, 38 aa, Artificial Sequence
  Description of Artificial Sequence: Synthetic peptide
  MOD_RES (16)..(16): Orn
GVIINVKCKISAQCLXPCKDAGMRFGACMNGKCACGGG

SEQ ID NO: 2424 - protein, 38 aa, Artificial Sequence; identical to SEQ ID NO: 2423
  Description of Artificial Sequence: Synthetic peptide
  MOD_RES (16)..(16): hLys

SEQ ID NO: 2425 - protein, 38 aa, Artificial Sequence; identical to SEQ ID NO: 2423
  Description of Artificial Sequence: Synthetic peptide
  MOD_RES (16)..(16): hArg

SEQ ID NO: 2426 - protein, 38 aa, Artificial Sequence; identical to SEQ ID NO: 2423
  Description of Artificial Sequence: Synthetic peptide
  MOD_RES (16)..(16): Cit

SEQ ID NO: 2427 - protein, 38 aa, Artificial Sequence; identical to SEQ ID NO: 2423
  Description of Artificial Sequence: Synthetic peptide
  MOD_RES (16)..(16): hCit

SEQ ID NO: 2428 - protein, 38 aa, Artificial Sequence; identical to SEQ ID NO: 2423
  Description of Artificial Sequence: Synthetic peptide
  MOD_RES (16)..(16): Dpr

SEQ ID NO: 2429 - protein, 38 aa, Artificial Sequence; identical to SEQ ID NO: 2423
  Description of Artificial Sequence: Synthetic peptide
  MOD_RES (16)..(16): Dab

SEQ ID NO: 2430 - protein, 37 aa, Artificial Sequence
  Description of Artificial Sequence: Synthetic peptide
GVIINVKCKISAQCLKPCKDAGMRFGACMNGKCACGG

SEQ ID NO: 2431 - protein, 37 aa, Artificial Sequence; identical to SEQ ID NO: 2415
  Description of Artificial Sequence: Synthetic peptide

SEQ ID NO: 2432 - protein, 37 aa, Artificial Sequence
  Description of Artificial Sequence: Synthetic peptide
  MOD_RES (16)..(16): Orn
GVIINVKCKISAQCLXPCKDAGMRFGACMNGKCACGG

SEQ ID NO: 2433 - protein, 38 aa, Artificial Sequence
  Description of Artificial Sequence: Synthetic peptide
  MOD_RES (16)..(16): hLys
GVIINVKCKISAQCLXPCKEAGMRFGACMNGKCHCTPK

SEQ ID NO: 2434 - protein, 38 aa, Artificial Sequence; identical to SEQ ID NO: 2433
  Description of Artificial Sequence: Synthetic peptide
  MOD_RES (16)..(16): hArg

SEQ ID NO: 2435 - protein, 38 aa, Artificial Sequence; identical to SEQ ID NO: 2433
  Description of Artificial Sequence: Synthetic peptide
  MOD_RES (16)..(16): Cit

SEQ ID NO: 2436 - protein, 38 aa, Artificial Sequence; identical to SEQ ID NO: 2433
  Description of Artificial Sequence: Synthetic peptide
  MOD_RES (16)..(16): hCit

SEQ ID NO: 2437 - protein, 38 aa, Artificial Sequence; identical to SEQ ID NO: 2433
  Description of Artificial Sequence: Synthetic peptide
  MOD_RES (16)..(16): Dpr

SEQ ID NO: 2438 - protein, 38 aa, Artificial Sequence; identical to SEQ ID NO: 2433
  Description of Artificial Sequence: Synthetic peptide
  MOD_RES (16)..(16): Dab

SEQ ID NO: 2439 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCHCYPK

SEQ ID NO: 2440 - protein, 38 aa, Artificial Sequence; identical to SEQ ID NO: 2439
  Description of Artificial Sequence: Synthetic peptide
  MOD_RES (16)..(16): hLys

SEQ ID NO: 2441 - protein, 38 aa, Artificial Sequence; identical to SEQ ID NO: 2439
  Description of Artificial Sequence: Synthetic peptide
  MOD_RES (16)..(16): hArg

SEQ ID NO: 2442 - protein, 38 aa, Artificial Sequence; identical to SEQ ID NO: 2439
  Description of Artificial Sequence: Synthetic peptide
  MOD_RES (16)..(16): Cit

SEQ ID NO: 2443 - protein, 38 aa, Artificial Sequence; identical to SEQ ID NO: 2439
  Description of Artificial Sequence: Synthetic peptide
  MOD_RES (16)..(16): hCit

SEQ ID NO: 2444 - protein, 38 aa, Artificial Sequence; identical to SEQ ID NO: 2439
  Description of Artificial Sequence: Synthetic peptide
  MOD_RES (16)..(16): Dpr

SEQ ID NO: 2445 - protein, 38 aa, Artificial Sequence; identical to SEQ ID NO: 2439
  Description of Artificial Sequence: Synthetic peptide
  MOD_RES (16)..(16): Dab

SEQ ID NO: 2446 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCACTPK

SEQ ID NO: 2447 - protein, 38 aa, Artificial Sequence; identical to SEQ ID NO: 2446
  Description of Artificial Sequence: Synthetic peptide
  MOD_RES (16)..(16): hLys

SEQ ID NO: 2448 - protein, 38 aa, Artificial Sequence; identical to SEQ ID NO: 2446
  Description of Artificial Sequence: Synthetic peptide
  MOD_RES (16)..(16): hArg

SEQ ID NO: 2449 - protein, 38 aa, Artificial Sequence; identical to SEQ ID NO: 2446
  Description of Artificial Sequence: Synthetic peptide
  MOD_RES (16)..(16): Cit

SEQ ID NO: 2450 - protein, 38 aa, Artificial Sequence; identical to SEQ ID NO: 2433
  Description of Artificial Sequence: Synthetic peptide
  MOD_RES (16)..(16): hCit

SEQ ID NO: 2451 - protein, 38 aa, Artificial Sequence; identical to SEQ ID NO: 2446
  Description of Artificial Sequence: Synthetic peptide
  MOD_RES (16)..(16): Dpr

SEQ ID NO: 2452 - protein, 38 aa, Artificial Sequence; identical to SEQ ID NO: 2446
  Description of Artificial Sequence: Synthetic peptide
  MOD_RES (16)..(16): Dab

SEQ ID NO: 2453 - protein, 35 aa, Artificial Sequence
  Description of Artificial Sequence: Synthetic peptide
  MOD_RES (16)..(16): Orn
GVIINVKCKISAQCLXPCKEAGMRFGACMNGKCHC

SEQ ID NO: 2454 - protein, 35 aa, Artificial Sequence; identical to SEQ ID NO: 2453
  Description of Artificial Sequence: Synthetic peptide
  MOD_RES (16)..(16): hLys

SEQ ID NO: 2455 - protein, 35 aa, Artificial Sequence; identical to SEQ ID NO: 2453
  Description of Artificial Sequence: Synthetic peptide
  MOD_RES (16)..(16): hArg

SEQ ID NO: 2456 - protein, 35 aa, Artificial Sequence; identical to SEQ ID NO: 2453
  Description of Artificial Sequence: Synthetic peptide
  MOD_RES (16)..(16): Cit

SEQ ID NO: 2457 - protein, 35 aa, Artificial Sequence; identical to SEQ ID NO: 2453
  Description of Artificial Sequence: Synthetic peptide
  MOD_RES (16)..(16): hCit

SEQ ID NO: 2458 - protein, 35 aa, Artificial Sequence; identical to SEQ ID NO: 2453
  Description of Artificial Sequence: Synthetic peptide
  MOD_RES (16)..(16): Dpr

SEQ ID NO: 2459 - protein, 35 aa, Artificial Sequence
  Description of Artificial Sequence: Synthetic peptide
  MOD_RES (16)..(16): Orn
GVIINVKCKISAQCLXPCKEAGMRFGACMNGKCAC

SEQ ID NO: 2460 - protein, 35 aa, Artificial Sequence; identical to SEQ ID NO: 2459
  Description of Artificial Sequence: Synthetic peptide
  MOD_RES (16)..(16): hLys

SEQ ID NO: 2461 - protein, 35 aa, Artificial Sequence; identical to SEQ ID NO: 2459
  Description of Artificial Sequence: Synthetic peptide
  MOD_RES (16)..(16): hArg

SEQ ID NO: 2462 - protein, 35 aa, Artificial Sequence; identical to SEQ ID NO: 2459
  Description of Artificial Sequence: Synthetic peptide
  MOD_RES (16)..(16): Cit

SEQ ID NO: 2463 - protein, 35 aa, Artificial Sequence; identical to SEQ ID NO: 2453
  Description of Artificial Sequence: Synthetic peptide
  MOD_RES (16)..(16): hCit

SEQ ID NO: 2464 - protein, 35 aa, Artificial Sequence; identical to SEQ ID NO: 2459
  Description of Artificial Sequence: Synthetic peptide
  MOD_RES (16)..(16): Dpr

SEQ ID NO: 2465 - protein, 35 aa, Artificial Sequence; identical to SEQ ID NO: 2459
  Description of Artificial Sequence: Synthetic peptide
  MOD_RES (16)..(16): Dab

SEQ ID NO: 2466 - protein, 38 aa, Artificial Sequence
  Description of Artificial Sequence: Synthetic peptide
GVIINVKCKISAQCLKPCKEAGMRFGACMNGKCHCYGG

SEQ ID NO: 2467 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCHCYGG

SEQ ID NO: 2468 - protein, 37 aa, Artificial Sequence
  Description of Artificial Sequence: Synthetic peptide
GVIINVKCKISAQCLKPCKEAGMRFGACMNGKCHCYG

SEQ ID NO: 2469 - protein, 37 aa, Artificial Sequence
  Description of Artificial Sequence: Synthetic peptide
GVIINVKCKISAQCLKPCKEAGMRFGACMNGKCACYG

SEQ ID NO: 2470 - protein, 38 aa, Artificial Sequence; identical to SEQ ID NO: 2467
  Description of Artificial Sequence: Synthetic peptide
  MOD_RES (16)..(16): hLys

SEQ ID NO: 2471 - protein, 38 aa, Artificial Sequence; identical to SEQ ID NO: 2467
  Description of Artificial Sequence: Synthetic peptide
  MOD_RES (16)..(16): hArg

SEQ ID NO: 2472 - protein, 38 aa, Artificial Sequence; identical to SEQ ID NO: 2467
  Description of Artificial Sequence: Synthetic peptide
  MOD_RES (16)..(16): Cit

SEQ ID NO: 2473 - protein, 38 aa, Artificial Sequence; identical to SEQ ID NO: 2467
  Description of Artificial Sequence: Synthetic peptide
  MOD_RES (16)..(16): hCit

SEQ ID NO: 2474 - protein, 38 aa, Artificial Sequence; identical to SEQ ID NO: 2467
  Description of Artificial Sequence: Synthetic peptide
  MOD_RES (16)..(16): Dpr

SEQ ID NO: 2475 - protein, 38 aa, Artificial Sequence; identical to SEQ ID NO: 2467
  Description of Artificial Sequence: Synthetic peptide
  MOD_RES (16)..(16): Dab

SEQ ID NO: 2476 - protein, 37 aa, Artificial Sequence; identical to SEQ ID NO: 2469
  Description of Artificial Sequence: Synthetic peptide

SEQ ID NO: 2477 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCACYGG

SEQ ID NO: 2478 - protein, 38 aa, Artificial Sequence; identical to SEQ ID NO: 2477
  Description of Artificial Sequence: Synthetic peptide
  MOD_RES (16)..(16): hLys

SEQ ID NO: 2479 - protein, 38 aa, Artificial Sequence; identical to SEQ ID NO: 2477
  Description of Artificial Sequence: Synthetic peptide
  MOD_RES (16)..(16): hArg

SEQ ID NO: 2480 - protein, 38 aa, Artificial Sequence; identical to SEQ ID NO: 2477
  Description of Artificial Sequence: Synthetic peptide
  MOD_RES (16)..(16): Cit

SEQ ID NO: 2481 - protein, 38 aa, Artificial Sequence; identical to SEQ ID NO: 2467
  Description of Artificial Sequence: Synthetic peptide
  MOD_RES (16)..(16): hCit

SEQ ID NO: 2482 - protein, 38 aa, Artificial Sequence; identical to SEQ ID NO: 2477
  Description of Artificial Sequence: Synthetic peptide
  MOD_RES (16)..(16): Dpr

SEQ ID NO: 2483 - protein, 38 aa, Artificial Sequence; identical to SEQ ID NO: 2477
  Description of Artificial Sequence: Synthetic peptide
  MOD_RES (16)..(16): Dab

SEQ ID NO: 2484 - protein, 38 aa, Artificial Sequence
  Description of Artificial Sequence: Synthetic peptide
GVIINVKCKISAQCLKPCKEAGMRFGACMNGKCACFGG

SEQ ID NO: 2485 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCHCGGG

SEQ ID NO: 2486 - protein, 38 aa, Artificial Sequence; identical to SEQ ID NO: 2485
  Description of Artificial Sequence: Synthetic peptide
  MOD_RES (16)..(16): hLys

SEQ ID NO: 2487 - protein, 38 aa, Artificial Sequence; identical to SEQ ID NO: 2485
  Description of Artificial Sequence: Synthetic peptide
  MOD_RES (16)..(16): hArg

SEQ ID NO: 2488 - protein, 38 aa, Artificial Sequence; identical to SEQ ID NO: 2485
  Description of Artificial Sequence: Synthetic peptide
  MOD_RES (16)..(16): Cit

SEQ ID NO: 2489 - protein, 38 aa, Artificial Sequence; identical to SEQ ID NO: 2485
  Description of Artificial Sequence: Synthetic peptide
  MOD_RES (16)..(16): hCit

SEQ ID NO: 2490 - protein, 38 aa, Artificial Sequence; identical to SEQ ID NO: 2485
  Description of Artificial Sequence: Synthetic peptide
  MOD_RES (16)..(16): Dpr

SEQ ID NO: 2491 - protein, 38 aa, Artificial Sequence
  Description of Artificial Sequence: Synthetic peptide
  MOD_RES (16)..(16): Orn
GVIINVKCKISAQCLXPCKEAGMRFGACMNGKCACGGG

SEQ ID NO: 2492 - protein, 38 aa, Artificial Sequence; identical to SEQ ID NO: 2491
  Description of Artificial Sequence: Synthetic peptide
  MOD_RES (16)..(16): hLys

SEQ ID NO: 2493 - protein, 38 aa, Artificial Sequence; identical to SEQ ID NO: 2491
  Description of Artificial Sequence: Synthetic peptide
  MOD_RES (16)..(16): hArg

SEQ ID NO: 2494 - protein, 38 aa, Artificial Sequence; identical to SEQ ID NO: 2491
  Description of Artificial Sequence: Synthetic peptide
  MOD_RES (16)..(16): Cit

SEQ ID NO: 2495 - protein, 37 aa, Artificial Sequence
  Description of Artificial Sequence: Synthetic peptide
  MOD_RES (16)..(16): hCit
GVIINVKCKISAQCLXPCKEAGMRFGACMNGKCACTP

SEQ ID NO: 2496 - protein, 37 aa, Artificial Sequence; identical to SEQ ID NO: 2495
  Description of Artificial Sequence: Synthetic peptide
  MOD_RES (16)..(16): Dpr

SEQ ID NO: 2497 - protein, 37 aa, Artificial Sequence; identical to SEQ ID NO: 2495
  Description of Artificial Sequence: Synthetic peptide
  MOD_RES (16)..(16): Dab

SEQ ID NO: 2498 - protein, 38 aa, Artificial Sequence; identical to SEQ ID NO: 2359
  Description of Artificial Sequence: Synthetic peptide
  MOD_RES (16)..(16): Orn
  c-term amidation

SEQ ID NO: 2499 - protein, 38 aa, Artificial Sequence; identical to SEQ ID NO: 2359
  Description of Artificial Sequence: Synthetic peptide
  MOD_RES (16)..(16): hLys
  c-term amidation

SEQ ID NO: 2500 - protein, 38 aa, Artificial Sequence; identical to SEQ ID NO: 2359
  Description of Artificial Sequence: Synthetic peptide
  MOD_RES (16)..(16): hArg
  c-term amidation

SEQ ID NO: 2501 - protein, 38 aa, Artificial Sequence; identical to SEQ ID NO: 2359
  Description of Artificial Sequence: Synthetic peptide
  MOD_RES (16)..(16): Cit
  c-term amidation

SEQ ID NO: 2502 - protein, 38 aa, Artificial Sequence; identical to SEQ ID NO: 2359
  Description of Artificial Sequence: Synthetic peptide
  MOD_RES (16)..(16): hCit
  c-term amidation

SEQ ID NO: 2503 - protein, 38 aa, Artificial Sequence; identical to SEQ ID NO: 2359
  Description of Artificial Sequence: Synthetic peptide
  MOD_RES (16)..(16): Dpr
  c-term amidation

SEQ ID NO: 2504 - protein, 38 aa, Artificial Sequence; identical to SEQ ID NO: 2359
  Description of Artificial Sequence: Synthetic peptide
  MOD_RES (16)..(16): Dab
  c-term amidation

SEQ ID NO: 2505 - protein, 38 aa, Artificial Sequence; identical to SEQ ID NO: 2366
  Description of Artificial Sequence: Synthetic peptide
  MOD_RES (16)..(16): Orn
  c-term amidation

SEQ ID NO: 2506 - protein, 38 aa, Artificial Sequence; identical to SEQ ID NO: 2366
  Description of Artificial Sequence: Synthetic peptide
  MOD_RES (16)..(16): hLys
  c-term amidation

SEQ ID NO: 2507 - protein, 38 aa, Artificial Sequence; identical to SEQ ID NO: 2366
  Description of Artificial Sequence: Synthetic peptide
  MOD_RES (16)..(16): hArg
  c-term amidation

SEQ ID NO: 2508 - protein, 38 aa, Artificial Sequence; identical to SEQ ID NO: 2366
  Description of Artificial Sequence: Synthetic peptide
  MOD_RES (16)..(16): Cit
  c-term amidation

SEQ ID NO: 2509 - protein, 38 aa, Artificial Sequence; identical to SEQ ID NO: 2366
  Description of Artificial Sequence: Synthetic peptide
  MOD_RES (16)..(16): hCit
  c-term amidation

SEQ ID NO: 2510 - protein, 38 aa, Artificial Sequence; identical to SEQ ID NO: 2366
  Description of Artificial Sequence: Synthetic peptide
  MOD_RES (16)..(16): Dpr
  c-term amidation

SEQ ID NO: 2511 - protein, 38 aa, Artificial Sequence; identical to SEQ ID NO: 2366
  Description of Artificial Sequence: Synthetic peptide
  MOD_RES (16)..(16): Dab
  c-term amidation

SEQ ID NO: 2512 - protein, 38 aa, Artificial Sequence; identical to SEQ ID NO: 2378
  Description of Artificial Sequence: Synthetic peptide
  MOD_RES (16)..(16): Orn
  c-term amidation

SEQ ID NO: 2513 - protein, 38 aa, Artificial Sequence; identical to SEQ ID NO: 2378
  Description of Artificial Sequence: Synthetic peptide
  MOD_RES (16)..(16): hLys
  c-term amidation

SEQ ID NO: 2514 - protein, 38 aa, Artificial Sequence; identical to SEQ ID NO: 2378
  Description of Artificial Sequence: Synthetic peptide
  MOD_RES (16)..(16): hArg
  c-term amidation

SEQ ID NO: 2515 - protein, 38 aa, Artificial Sequence; identical to SEQ ID NO: 2378
  Description of Artificial Sequence: Synthetic peptide
  MOD_RES (16)..(16): Cit
  c-term amidation

SEQ ID NO: 2516 - protein, 38 aa, Artificial Sequence; identical to SEQ ID NO: 2378
  Description of Artificial Sequence: Synthetic peptide
  MOD_RES (16)..(16): hCit
  c-term amidation

SEQ ID NO: 2517 - protein, 38 aa, Artificial Sequence; identical to SEQ ID NO: 2378
  Description of Artificial Sequence: Synthetic peptide
  MOD_RES (16)..(16): Dpr
  c-term amidation

SEQ ID NO: 2518 - protein, 38 aa, Artificial Sequence; identical to SEQ ID NO: 2378
  Description of Artificial Sequence: Synthetic peptide
  MOD_RES (16)..(16): Dab
  c-term amidation

SEQ ID NO: 2519 - protein, 35 aa, Artificial Sequence; identical to SEQ ID NO: 2385
  Description of Artificial Sequence: Synthetic peptide
  MOD_RES (16)..(16): Orn
  c-term amidation

SEQ ID NO: 2520 - protein, 35 aa, Artificial Sequence; identical to SEQ ID NO: 2385
  Description of Artificial Sequence: Synthetic peptide
  MOD_RES (16)..(16): hLys
  c-term amidation

SEQ ID NO: 2521 - protein, 35 aa, Artificial Sequence; identical to SEQ ID NO: 2385
  Description of Artificial Sequence: Synthetic peptide
  MOD_RES (16)..(16): hArg
  c-term amidation

SEQ ID NO: 2522 - protein, 35 aa, Artificial Sequence; identical to SEQ ID NO: 2385
  Description of Artificial Sequence: Synthetic peptide
  MOD_RES (16)..(16): Cit
  c-term amidation

SEQ ID NO: 2523 - protein, 35 aa, Artificial Sequence; identical to SEQ ID NO: 2385
  Description of Artificial Sequence: Synthetic peptide
  MOD_RES (16)..(16): hCit
  c-term amidation

SEQ ID NO: 2524 - protein, 35 aa, Artificial Sequence; identical to SEQ ID NO: 2385
  Description of Artificial Sequence: Synthetic peptide
  MOD_RES (16)..(16): Dpr
  c-term amidation

SEQ ID NO: 2525 - protein, 33 aa, Artificial Sequence
  Description of Artificial Sequence: Synthetic peptide
  MOD_RES (16)..(16): Orn
  c-term amidation
GVIINVKCKISAQCLXPCKDAGMRFGACMNGKC

SEQ ID NO: 2526 - protein, 33 aa, Artificial Sequence; identical to SEQ ID NO: 2525
  Description of Artificial Sequence: Synthetic peptide
  MOD_RES (16)..(16): hLys
  c-term amidation

SEQ ID NO: 2527 - protein, 33 aa, Artificial Sequence; identical to SEQ ID NO: 2525
  Description of Artificial Sequence: Synthetic peptide
  MOD_RES (16)..(16): hArg
  c-term amidation

SEQ ID NO: 2528 - protein, 33 aa, Artificial Sequence; identical to SEQ ID NO: 2525
  Description of Artificial Sequence: Synthetic peptide
  MOD_RES (16)..(16): Cit
  c-term amidation

SEQ ID NO: 2529 - protein, 35 aa, Artificial Sequence; identical to SEQ ID NO: 2385
  Description of Artificial Sequence: Synthetic peptide
  MOD_RES (16)..(16): hCit
  c-term amidation

SEQ ID NO: 2530 - protein, 33 aa, Artificial Sequence; identical to SEQ ID NO: 2525
  Description of Artificial Sequence: Synthetic peptide
  MOD_RES (16)..(16): Dpr
  c-term amidation

SEQ ID NO: 2531 - protein, 33 aa, Artificial Sequence; identical to SEQ ID NO: 2525
  Description of Artificial Sequence: Synthetic peptide
  MOD_RES (16)..(16): Dab
  c-term amidation

SEQ ID NO: 2532 - protein, 38 aa, Artificial Sequence
  Description of Artificial Sequence: Synthetic peptide
  c-term amidation
GVIINVKCKISAQCLKPCKDAGMRFGACMNGKCHCYGG

SEQ ID NO: 2533 - protein, 38 aa, Artificial Sequence; identical to SEQ ID NO: 2400
  Description of Artificial Sequence: Synthetic peptide
  MOD_RES (16)..(16): Orn
  c-term amidation

SEQ ID NO: 2534 - protein, 38 aa, Artificial Sequence; identical to SEQ ID NO: 2400
  Description of Artificial Sequence: Synthetic peptide
  MOD_RES (16)..(16): hLys
  c-term amidation

SEQ ID NO: 2535 - protein, 38 aa, Artificial Sequence; identical to SEQ ID NO: 2400
  Description of Artificial Sequence: Synthetic peptide
  MOD_RES (16)..(16): hArg
  c-term amidation

SEQ ID NO: 2536 - protein, 38 aa, Artificial Sequence; identical to SEQ ID NO: 2400
  Description of Artificial Sequence: Synthetic peptide
  MOD_RES (16)..(16): Cit
  c-term amidation

SEQ ID NO: 2537 - protein, 38 aa, Artificial Sequence; identical to SEQ ID NO: 2400
  Description of Artificial Sequence: Synthetic peptide
  MOD_RES (16)..(16): hCit
  c-term amidation

SEQ ID NO: 2538 - protein, 38 aa, Artificial Sequence; identical to SEQ ID NO: 2400
  Description of Artificial Sequence: Synthetic peptide
  MOD_RES (16)..(16): Dpr
  c-term amidation

SEQ ID NO: 2539 - protein, 38 aa, Artificial Sequence
  Description of Artificial Sequence: Synthetic peptide
  c-term amidation
GVIINVKCKISAQCLKPCKDAGMRFGACMNGKCHCFGG

SEQ ID NO: 2540 - protein, 37 aa, Artificial Sequence
  Description of Artificial Sequence: Synthetic peptide
  c-term amidation
GVIINVKCKISAQCLKPCKDAGMRFGACMNGKCHCYG

SEQ ID NO: 2541 - protein, 37 aa, Artificial Sequence; identical to SEQ ID NO: 2415
  Description of Artificial Sequence: Synthetic peptide
  c-term amidation

SEQ ID NO: 2542 - protein, 38 aa, Artificial Sequence; identical to SEQ ID NO: 2407
  Description of Artificial Sequence: Synthetic peptide
  MOD_RES (16)..(16): Orn
  c-term amidation

SEQ ID NO: 2543 - protein, 38 aa, Artificial Sequence; identical to SEQ ID NO: 2407
  Description of Artificial Sequence: Synthetic peptide
  MOD_RES (16)..(16): hLys
  c-term amidation

SEQ ID NO: 2544 - protein, 38 aa, Artificial Sequence; identical to SEQ ID NO: 2407
  Description of Artificial Sequence: Synthetic peptide
  MOD_RES (16)..(16): hArg
  c-term amidation

SEQ ID NO: 2545 - protein, 38 aa, Artificial Sequence; identical to SEQ ID NO: 2407
  Description of Artificial Sequence: Synthetic peptide
  MOD_RES (16)..(16): Cit
  c-term amidation

SEQ ID NO: 2546 - protein, 38 aa, Artificial Sequence; identical to SEQ ID NO: 2407
  Description of Artificial Sequence: Synthetic peptide
  MOD_RES (16)..(16): hCit
  c-term amidation

SEQ ID NO: 2547 - protein, 38 aa, Artificial Sequence; identical to SEQ ID NO: 2407
  Description of Artificial Sequence: Synthetic peptide
  MOD_RES (16)..(16): Dpr
  c-term amidation

SEQ ID NO: 2548 - protein, 38 aa, Artificial Sequence; identical to SEQ ID NO: 2407
  Description of Artificial Sequence: Synthetic peptide
  MOD_RES (16)..(16): Dab
  c-term amidation

SEQ ID NO: 2549 - protein, 38 aa, Artificial Sequence; identical to SEQ ID NO: 2406
  Description of Artificial Sequence: Synthetic peptide
  c-term amidation

SEQ ID NO: 2550 - protein, 38 aa, Artificial Sequence; identical to SEQ ID NO: 2416
  Description of Artificial Sequence: Synthetic peptide
  MOD_RES (16)..(16): Orn
  c-term amidation

SEQ ID NO: 2551 - protein, 38 aa, Artificial Sequence; identical to SEQ ID NO: 2416
  Description of Artificial Sequence: Synthetic peptide
  MOD_RES (16)..(16): hLys
  c-term amidation

SEQ ID NO: 2552 - protein, 38 aa, Artificial Sequence; identical to SEQ ID NO: 2416
  Description of Artificial Sequence: Synthetic peptide
  MOD_RES (16)..(16): hArg
  c-term amidation

SEQ ID NO: 2553 - protein, 38 aa, Artificial Sequence; identical to SEQ ID NO: 2416
  Description of Artificial Sequence: Synthetic peptide
  MOD_RES (16)..(16): Cit
  c-term amidation

SEQ ID NO: 2554 - protein, 38 aa, Artificial Sequence; identical to SEQ ID NO: 2416
  Description of Artificial Sequence: Synthetic peptide
  MOD_RES (16)..(16): hCit
  c-term amidation

SEQ ID NO: 2555 - protein, 38 aa, Artificial Sequence; identical to SEQ ID NO: 2416
  Description of Artificial Sequence: Synthetic peptide
  MOD_RES (16)..(16): Dpr
  c-term amidation

SEQ ID NO: 2556 - protein, 38 aa, Artificial Sequence
  Description of Artificial Sequence: Synthetic peptide
  c-term amidation
GVIINVKCKISAQCLKPCKDAGMRFGACMNGKCACGGG

SEQ ID NO: 2557 - protein, 38 aa, Artificial Sequence
  Description of Artificial Sequence: Synthetic peptide
  MOD_RES (16)..(16): Orn
  c-term amidation
GVIINVKCKISAQCLXPCKDAGMRFGACMNGKCACFGG

SEQ ID NO: 2558 - protein, 38 aa, Artificial Sequence; identical to SEQ ID NO: 2423
  Description of Artificial Sequence: Synthetic peptide
  MOD_RES (16)..(16): Orn
  c-term amidation

SEQ ID NO: 2559 - protein, 38 aa, Artificial Sequence; identical to SEQ ID NO: 2423
  Description of Artificial Sequence: Synthetic peptide
  MOD_RES (16)..(16): hLys
  c-term amidation

SEQ ID NO: 2560 - protein, 38 aa, Artificial Sequence; identical to SEQ ID NO: 2423
  Description of Artificial Sequence: Synthetic peptide
  MOD_RES (16)..(16): hArg
  c-term amidation

SEQ ID NO: 2561 - protein, 38 aa, Artificial Sequence; identical to SEQ ID NO: 2423
  Description of Artificial Sequence: Synthetic peptide
  MOD_RES (16)..(16): Cit
  c-term amidation

SEQ ID NO: 2562 - protein, 38 aa, Artificial Sequence; identical to SEQ ID NO: 2423
  Description of Artificial Sequence: Synthetic peptide
  MOD_RES (16)..(16): hCit
  c-term amidation

SEQ ID NO: 2563 - protein, 38 aa, Artificial Sequence; identical to SEQ ID NO: 2423
  Description of Artificial Sequence: Synthetic peptide
  MOD_RES (16)..(16): Dpr
  c-term amidation

SEQ ID NO: 2564 - protein, 38 aa, Artificial Sequence; identical to SEQ ID NO: 2423
  Description of Artificial Sequence: Synthetic peptide
  MOD_RES (16)..(16): Dab
  c-term amidation

SEQ ID NO: 2565 - protein, 38 aa, Artificial Sequence; identical to SEQ ID NO: 2433
  Description of Artificial Sequence: Synthetic peptide
  MOD_RES (16)..(16): Orn
  c-term amidation

SEQ ID NO: 2566 - protein, 38 aa, Artificial Sequence; identical to SEQ ID NO: 2433
  Description of Artificial Sequence: Synthetic peptide
  MOD_RES (16)..(16): hLys
  c-term amidation

SEQ ID NO: 2567 - protein, 38 aa, Artificial Sequence; identical to SEQ ID NO: 2433
  Description of Artificial Sequence: Synthetic peptide
  MOD_RES (16)..(16): hArg
  c-term amidation

SEQ ID NO: 2568 - protein, 38 aa, Artificial Sequence; identical to SEQ ID NO: 2433
  Description of Artificial Sequence: Synthetic peptide
  MOD_RES (16)..(16): Cit
  c-term amidation

SEQ ID NO: 2569 - protein, 38 aa, Artificial Sequence; identical to SEQ ID NO: 2433
  Description of Artificial Sequence: Synthetic peptide
  MOD_RES (16)..(16): hCit
  c-term amidation

SEQ ID NO: 2570 - protein, 38 aa, Artificial Sequence; identical to SEQ ID NO: 2433
  Description of Artificial Sequence: Synthetic peptide
  MOD_RES (16)..(16): Dpr
  c-term amidation

SEQ ID NO: 2571 - protein, 38 aa, Artificial Sequence; identical to SEQ ID NO: 2433
  Description of Artificial Sequence: Synthetic peptide
  MOD_RES (16)..(16): Dab
  c-term amidation

SEQ ID NO: 2572 - protein, 38 aa, Artificial Sequence; identical to SEQ ID NO: 2439
  Description of Artificial Sequence: Synthetic peptide
  MOD_RES (16)..(16): Orn
  c-term amidation

SEQ ID NO: 2573 - protein, 38 aa, Artificial Sequence; identical to SEQ ID NO: 2439
  Description of Artificial Sequence: Synthetic peptide
  MOD_RES (16)..(16): hLys
  c-term amidation

SEQ ID NO: 2574 - protein, 38 aa, Artificial Sequence; identical to SEQ ID NO: 2439
  Description of Artificial Sequence: Synthetic peptide
  MOD_RES (16)..(16): hArg
  c-term amidation

SEQ ID NO: 2575 - protein, 38 aa, Artificial Sequence; identical to SEQ ID NO: 2439
  Description of Artificial Sequence: Synthetic peptide
  MOD_RES (16)..(16): Cit
  c-term amidation

SEQ ID NO: 2576 - protein, 38 aa, Artificial Sequence; identical to SEQ ID NO: 2439
  Description of Artificial Sequence: Synthetic peptide
  MOD_RES (16)..(16): hCit
  c-term amidation

SEQ ID NO: 2577 - protein, 38 aa, Artificial Sequence; identical to SEQ ID NO: 2439
  Description of Artificial Sequence: Synthetic peptide
  MOD_RES (16)..(16): Dpr
  c-term amidation

SEQ ID NO: 2578 - protein, 38 aa, Artificial Sequence; identical to SEQ ID NO: 2439
  Description of Artificial Sequence: Synthetic peptide
  MOD_RES (16)..(16): Dab
  c-term amidation

SEQ ID NO: 2579 - protein, 38 aa, Artificial Sequence; identical to SEQ ID NO: 2446
  Description of Artificial Sequence: Synthetic peptide
  MOD_RES (16)..(16): Orn
  c-term amidation

SEQ ID NO: 2580 - protein, 38 aa, Artificial Sequence; identical to SEQ ID NO: 2446
  Description of Artificial Sequence: Synthetic peptide
  MOD_RES (16)..(16): hLys
  c-term amidation

SEQ ID NO: 2581 - protein, 38 aa, Artificial Sequence; identical to SEQ ID NO: 2446
  Description of Artificial Sequence: Synthetic peptide
  MOD_RES (16)..(16): hArg
  c-term amidation

SEQ ID NO: 2582 - protein, 38 aa, Artificial Sequence; identical to SEQ ID NO: 2446
  Description of Artificial Sequence: Synthetic peptide
  MOD_RES (16)..(16): Cit
  c-term amidation

SEQ ID NO: 2583 - protein, 38 aa, Artificial Sequence; identical to SEQ ID NO: 2446
  Description of Artificial Sequence: Synthetic peptide
  MOD_RES (16)..(16): hCit
  c-term amidation

SEQ ID NO: 2584 - protein, 38 aa, Artificial Sequence; identical to SEQ ID NO: 2446
  Description of Artificial Sequence: Synthetic peptide
  MOD_RES (16)..(16): Dpr
  c-term amidation

SEQ ID NO: 2585 - protein, 38 aa, Artificial Sequence; identical to SEQ ID NO: 2446
  Description of Artificial Sequence: Synthetic peptide
  MOD_RES (16)..(16): Dab
  c-term amidation

SEQ ID NO: 2586 - protein, 35 aa, Artificial Sequence; identical to SEQ ID NO: 2453
  Description of Artificial Sequence: Synthetic peptide
  MOD_RES (16)..(16): Orn
  c-term amidation

SEQ ID NO: 2587 - protein, 35 aa, Artificial Sequence; identical to SEQ ID NO: 2453
  Description of Artificial Sequence: Synthetic peptide
  MOD_RES (16)..(16): hLys
  c-term amidation

SEQ ID NO: 2588 - protein, 35 aa, Artificial Sequence; identical to SEQ ID NO: 2453
  Description of Artificial Sequence: Synthetic peptide
  MOD_RES (16)..(16): hArg
  c-term amidation

SEQ ID NO: 2589 - protein, 35 aa, Artificial Sequence; identical to SEQ ID NO: 2453
  Description of Artificial Sequence: Synthetic peptide
  MOD_RES (16)..(16): Cit
  c-term amidation

SEQ ID NO: 2590 - protein, 35 aa, Artificial Sequence; identical to SEQ ID NO: 2453
  Description of Artificial Sequence: Synthetic peptide
  MOD_RES (16)..(16): hCit
  c-term amidation

SEQ ID NO: 2591 - protein, 35 aa, Artificial Sequence; identical to SEQ ID NO: 2453
  Description of Artificial Sequence: Synthetic peptide
  MOD_RES (16)..(16): Dpr
  c-term amidation

SEQ ID NO: 2592 - protein, 33 aa, Artificial Sequence
  Description of Artificial Sequence: Synthetic peptide
  MOD_RES (16)..(16): Orn
  c-term amidation
GVIINVKCKISAQCLXPCKEAGMRFGACMNGKC

SEQ ID NO: 2593 - protein, 33 aa, Artificial Sequence; identical to SEQ ID NO: 2592
  Description of Artificial Sequence: Synthetic peptide
  MOD_RES (16)..(16): hLys
  c-term amidation

SEQ ID NO: 2594 - protein, 33 aa, Artificial Sequence; identical to SEQ ID NO: 2592
  Description of Artificial Sequence: Synthetic peptide
  MOD_RES (16)..(16): hArg
  c-term amidation

SEQ ID NO: 2595 - protein, 33 aa, Artificial Sequence; identical to SEQ ID NO: 2592
  Description of Artificial Sequence: Synthetic peptide
  MOD_RES (16)..(16): Cit
  c-term amidation

SEQ ID NO: 2596 - protein, 35 aa, Artificial Sequence; identical to SEQ ID NO: 2453
  Description of Artificial Sequence: Synthetic peptide
  MOD_RES (16)..(16): hCit
  c-term amidation

SEQ ID NO: 2597 - protein, 33 aa, Artificial Sequence; identical to SEQ ID NO: 2592
  Description of Artificial Sequence: Synthetic peptide
  MOD_RES (16)..(16): Dpr
  c-term amidation

SEQ ID NO: 2598 - protein, 33 aa, Artificial Sequence; identical to SEQ ID NO: 2592
  Description of Artificial Sequence: Synthetic peptide
  MOD_RES (16)..(16): Dab
  c-term amidation

SEQ ID NO: 2599 - protein, 38 aa, Artificial Sequence
  Description of Artificial Sequence: Synthetic peptide
  c-term amidation
GVIINVKCKISAQCLKPCKEAGMRFGACMNGKCHCWGG

SEQ ID NO: 2600 - protein, 38 aa, Artificial Sequence; identical to SEQ ID NO: 2467
  Description of Artificial Sequence: Synthetic peptide
  MOD_RES (16)..(16): Orn
  c-term amidation

SEQ ID NO: 2601 - protein, 38 aa, Artificial Sequence; identical to SEQ ID NO: 2467
  Description of Artificial Sequence: Synthetic peptide
  MOD_RES (16)..(16): hLys
  c-term amidation

SEQ ID NO: 2602 - protein, 38 aa, Artificial Sequence; identical to SEQ ID NO: 2467
  Description of Artificial Sequence: Synthetic peptide
  MOD_RES (16)..(16): hArg
  c-term amidation

SEQ ID NO: 2603 - protein, 38 aa, Artificial Sequence; identical to SEQ ID NO: 2467
  Description of Artificial Sequence: Synthetic peptide
  MOD_RES (16)..(16): Cit
  c-term amidation

SEQ ID NO: 2604 - protein, 38 aa, Artificial Sequence; identical to SEQ ID NO: 2467
  Description of Artificial Sequence: Synthetic peptide
  MOD_RES (16)..(16): hCit
  c-term amidation

SEQ ID NO: 2605 - protein, 38 aa, Artificial Sequence; identical to SEQ ID NO: 2467
  Description of Artificial Sequence: Synthetic peptide
  MOD_RES (16)..(16): Dpr
  c-term amidation

SEQ ID NO: 2606 - protein, 38 aa, Artificial Sequence; identical to SEQ ID NO: 2467
  Description of Artificial Sequence: Synthetic peptide
  MOD_RES (16)..(16): Dab
  c-term amidation

SEQ ID NO: 2607 - protein, 38 aa, Artificial Sequence
  Description of Artificial Sequence: Synthetic peptide
  c-term amidation
GVIINVKCKISAQCLKPCKEAGMRFGACMNGKCACYGG

SEQ ID NO: 2608 - protein, 38 aa, Artificial Sequence; identical to SEQ ID NO: 2477
  Description of Artificial Sequence: Synthetic peptide
  MOD_RES (16)..(16): Orn
  c-term amidation

SEQ ID NO: 2609 - protein, 38 aa, Artificial Sequence; identical to SEQ ID NO: 2477
  Description of Artificial Sequence: Synthetic peptide
  MOD_RES (16)..(16): hLys
  c-term amidation

SEQ ID NO: 2610 - protein, 38 aa, Artificial Sequence; identical to SEQ ID NO: 2477
  Description of Artificial Sequence: Synthetic peptide
  MOD_RES (16)..(16): hArg
  c-term amidation

SEQ ID NO: 2611 - protein, 38 aa, Artificial Sequence; identical to SEQ ID NO: 2477
  Description of Artificial Sequence: Synthetic peptide
  MOD_RES (16)..(16): Cit
  c-term amidation

SEQ ID NO: 2612 - protein, 38 aa, Artificial Sequence; identical to SEQ ID NO: 2467
  Description of Artificial Sequence: Synthetic peptide
  MOD_RES (16)..(16): hCit
  c-term amidation

SEQ ID NO: 2613 - protein, 38 aa, Artificial Sequence; identical to SEQ ID NO: 2477
  Description of Artificial Sequence: Synthetic peptide
  MOD_RES (16)..(16): Dpr
  c-term amidation

SEQ ID NO: 2614 - protein, 38 aa, Artificial Sequence; identical to SEQ ID NO: 2477
  Description of Artificial Sequence: Synthetic peptide
  MOD_RES (16)..(16): Dab
  c-term amidation

SEQ ID NO: 2615 - protein, 38 aa, Artificial Sequence; identical to SEQ ID NO: 2485
  Description of Artificial Sequence: Synthetic peptide
  MOD_RES (16)..(16): Orn
  c-term amidation

SEQ ID NO: 2616 - protein, 38 aa, Artificial Sequence; identical to SEQ ID NO: 2485
  Description of Artificial Sequence: Synthetic peptide
  MOD_RES (16)..(16): hLys
  c-term amidation

SEQ ID NO: 2617 - protein, 38 aa, Artificial Sequence; identical to SEQ ID NO: 2485
  Description of Artificial Sequence: Synthetic peptide
  MOD_RES (16)..(16): hArg
  c-term amidation

SEQ ID NO: 2618 - protein, 38 aa, Artificial Sequence; identical to SEQ ID NO: 2485
  Description of Artificial Sequence: Synthetic peptide
  MOD_RES (16)..(16): Cit
  c-term amidation

SEQ ID NO: 2619 - protein, 38 aa, Artificial Sequence; identical to SEQ ID NO: 2485
  Description of Artificial Sequence: Synthetic peptide
  MOD_RES (16)..(16): hCit
  c-term amidation

SEQ ID NO: 2620 - protein, 38 aa, Artificial Sequence; identical to SEQ ID NO: 2485
  Description of Artificial Sequence: Synthetic peptide
  MOD_RES (16)..(16): Dpr
  c-term amidation

SEQ ID NO: 2621 - protein, 38 aa, Artificial Sequence; identical to SEQ ID NO: 2491
  Description of Artificial Sequence: Synthetic peptide
  MOD_RES (16)..(16): Orn
  c-term amidation

SEQ ID NO: 2622 - protein, 38 aa, Artificial Sequence; identical to SEQ ID NO: 2491
  Description of Artificial Sequence: Synthetic peptide
  MOD_RES (16)..(16): hLys
  c-term amidation

SEQ ID NO: 2623 - protein, 38 aa, Artificial Sequence; identical to SEQ ID NO: 2491
  Description of Artificial Sequence: Synthetic peptide
  MOD_RES (16)..(16): hArg
  c-term amidation

SEQ ID NO: 2624 - protein, 38 aa, Artificial Sequence; identical to SEQ ID NO: 2491
  Description of Artificial Sequence: Synthetic peptide
  MOD_RES (16)..(16): Cit
  c-term amidation

SEQ ID NO: 2625 - protein, 37 aa, Artificial Sequence; identical to SEQ ID NO: 2495
  Description of Artificial Sequence: Synthetic peptide
  MOD_RES (16)..(16): hCit
  c-term amidation

SEQ ID NO: 2626 - protein, 38 aa, Artificial Sequence; identical to SEQ ID NO: 2491
  Description of Artificial Sequence: Synthetic peptide
  MOD_RES (16)..(16): Dpr
  c-term amidation

SEQ ID NO: 2627 - protein, 38 aa, Artificial Sequence; identical to SEQ ID NO: 2491
  Description of Artificial Sequence: Synthetic peptide
  MOD_RES (16)..(16): Dab
  c-term amidation

SEQ ID NO: 2628 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGACMNGKCACYGG

SEQ ID NO: 2629 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGACMNGKCACGGG

SEQ ID NO: 2630 - protein, 36 aa, Artificial Sequence
  Description of Artificial Sequence: Synthetic peptide
  MOD_RES (20)..(20): Cpa
  c-term amidation
GVIINVKCKISAQCLKPCKXAGMRFGACMNGKCACY

SEQ ID NO: 2631 - protein, 38 aa, Artificial Sequence; identical to SEQ ID NO: 2406
  Description of Artificial Sequence: Synthetic peptide
  n-term acetylation
  c-term amidation

SEQ ID NO: 2632 - protein, 38 aa, Artificial Sequence; identical to SEQ ID NO: 2628
  Description of Artificial Sequence: Synthetic peptide
  MOD_RES (20)..(20): Aad
  c-term amidation

SEQ ID NO: 2633 - protein, 38 aa, Artificial Sequence
  Description of Artificial Sequence: Synthetic peptide
  MOD_RES (20)..(20): Aad
  c-term amidation
GVIINVKCKISAQCLKPCKXAGMRFGACMNGKCHCYGG

SEQ ID NO: 2634 - protein, 38 aa, Artificial Sequence; identical to SEQ ID NO: 2628
  Description of Artificial Sequence: Synthetic peptide
  MOD_RES (20)..(20): Aad

SEQ ID NO: 2635 - protein, 38 aa, Artificial Sequence
  Description of Artificial Sequence: Synthetic peptide
  c-term amidation
GVIINVKCKISAQCLHPCKDAGMRFGACMNGKCACYGG

SEQ ID NO: 2636 - protein, 38 aa, Artificial Sequence; identical to SEQ ID NO: 2635
  Description of Artificial Sequence: Synthetic peptide

SEQ ID NO: 2637 - protein, 36 aa, Artificial Sequence
  Description of Artificial Sequence: Synthetic peptide
  c-term amidation
GVIINVKCKISAQCLHPCKDAGMRFGACMNGKCACY

SEQ ID NO: 2638 - protein, 38 aa, Artificial Sequence
  Description of Artificial Sequence: Synthetic peptide
  c-term amidation
GVIINVKCKISAQCLHPCKDAGMRFGACMNGKCHCYGG

SEQ ID NO: 2639 - protein, 38 aa, Artificial Sequence; identical to SEQ ID NO: 2638
  Description of Artificial Sequence: Synthetic peptide

SEQ ID NO: 2640 - protein, 38 aa, Artificial Sequence
  Description of Artificial Sequence: Synthetic peptide
GVIINVKCKISAQCLHPCKDAGMRFGACMNGKCHCYPK

SEQ ID NO: 2641 - protein, 35 aa, Artificial Sequence
  Description of Artificial Sequence: Synthetic peptide
GVIINVKCKISAQCLHPCKDAGMRFGACMNGKCAC

SEQ ID NO: 2642 - protein, 38 aa, Artificial Sequence
  Description of Artificial Sequence: Synthetic peptide
  MOD_RES (36)..(36): 1-Nal
  c-term amidation
GVIINVKCKISAQCLKPCKDAGMRFGACMNGKCACXGG

SEQ ID NO: 2643 - protein, 38 aa, Artificial Sequence
  Description of Artificial Sequence: Synthetic peptide
  MOD_RES (36)..(36): 1-Nal
  c-term amidation
GVIINVKCKISAQCLKPCKDAGMRFGACMNGKCACXPK

SEQ ID NO: 2644 - protein, 38 aa, Artificial Sequence; identical to SEQ ID NO: 2642
  Description of Artificial Sequence: Synthetic peptide
  MOD_RES (36)..(36): 2-Nal
  c-term amidation

SEQ ID NO: 2645 - protein, 38 aa, Artificial Sequence; identical to SEQ ID NO: 2642
  Description of Artificial Sequence: Synthetic peptide
  MOD_RES (36)..(36): Cha
  c-term amidation

SEQ ID NO: 2646 - protein, 38 aa, Artificial Sequence; identical to SEQ ID NO: 2642
  Description of Artificial Sequence: Synthetic peptide
  MOD_RES (36)..(36): MePhe
  c-term amidation

SEQ ID NO: 2647 - protein, 38 aa, Artificial Sequence; identical to SEQ ID NO: 2642
  Description of Artificial Sequence: Synthetic peptide
  MOD_RES (36)..(36): BiPhA
  c-term amidation

SEQ ID NO: 2648 - protein, 38 aa, Artificial Sequence
  Description of Artificial Sequence: Synthetic peptide
  MOD_RES (34)..(34): Aib
  c-term amidation
GVIINVKCKISAQCLKPCKDAGMRFGACMNGKCXCYGG

SEQ ID NO: 2649 - protein, 38 aa, Artificial Sequence; identical to SEQ ID NO: 2648
  Description of Artificial Sequence: Synthetic peptide
  MOD_RES (34)..(34): Abu
  c-term amidation

SEQ ID NO: 2650 - protein, 36 aa, Artificial Sequence
  Description of Artificial Sequence: Synthetic peptide
  MOD_RES (36)..(36): 1-Nal
GVIINVKCKISAQCLKPCKDAGMRFGACMNGKCACX

SEQ ID NO: 2651 - protein, 38 aa, Artificial Sequence
  Description of Artificial Sequence: Synthetic peptide
  MOD_RES (36)..(36): 1-Nal
  c-term amidation
GVIINVKCKISAQCLHPCKDAGMRFGACMNGKCACXGG

SEQ ID NO: 2652 - protein, 36 aa, Artificial Sequence; identical to SEQ ID NO: 2650
  Description of Artificial Sequence: Synthetic peptide
  MOD_RES (36)..(36): 4Bip
  c-term amidation

SEQ ID NO: 2653 - protein, 38 aa, Artificial Sequence; identical to SEQ ID NO: 2651
  Description of Artificial Sequence: Synthetic peptide
  MOD_RES (36)..(36): 4Bip
  c-term amidation

SEQ ID NO: 2654 - protein, 38 aa, Artificial Sequence
  Description of Artificial Sequence: Synthetic peptide
GVIINVKCKISAQCLKPCKDAGMRFGACMNGKCHCGGG

SEQ ID NO: 2655 - protein, 38 aa, Artificial Sequence
  Description of Artificial Sequence: Synthetic peptide
GVIINVKCKISAQCLEPCKKAGMRFGKCANGKCHCTPK

SEQ ID NO: 2656 - protein, 38 aa, Artificial Sequence
  Description of Artificial Sequence: Synthetic peptide
GVIINVSCKISAQCLEPCKKAGMRFGKCANGKCHCTPK

SEQ ID NO: 2657 - protein, 38 aa, Artificial Sequence
  Description of Artificial Sequence: Synthetic peptide
GVIINVKCKISAQCLKPCKKAGMRFGKCANGKCHCTPK

SEQ ID NO: 2658 - protein, 38 aa, Artificial Sequence
  Description of Artificial Sequence: Synthetic peptide
GVIINVKCKISAQCLEPCKDAGMRFGKCANGKCHCTPK

SEQ ID NO: 2659 - protein, 38 aa, Artificial Sequence
  Description of Artificial Sequence: Synthetic peptide
GVIINVKCKISAQCLKPCKDAGMRFGKCANGKCHCTPK

SEQ ID NO: 2660 - protein, 38 aa, Artificial Sequence
  Description of Artificial Sequence: Synthetic peptide
GVIINVSCKISAQCLKPCKDAGMRFGKCANGKCHCTPK

SEQ ID NO: 2661 - protein, 38 aa, Artificial Sequence
  Description of Artificial Sequence: Synthetic peptide
GVIINVKCKISPQCLKPCKDAGMRFGKCANGKCHCTPK

SEQ ID NO: 2662 - protein, 38 aa, Artificial Sequence
  Description of Artificial Sequence: Synthetic peptide
GVIINVKCKISAQCLKPCKDAGMRFGKCANGKCHCYPK

SEQ ID NO: 2663 - protein, 38 aa, Artificial Sequence; identical to SEQ ID NO: 2661
  Description of Artificial Sequence: Synthetic peptide
  n-term acetylation

SEQ ID NO: 2664 - protein, 38 aa, Artificial Sequence; identical to SEQ ID NO: 2661
  Description of Artificial Sequence: Synthetic peptide
  c-term amidation

SEQ ID NO: 2665 - protein, 38 aa, Artificial Sequence; identical to SEQ ID NO: 2661
  Description of Artificial Sequence: Synthetic peptide
  n-term acetylation
  c-term amidation

SEQ ID NO: 2666 - protein, 38 aa, Artificial Sequence; identical to SEQ ID NO: 2662
  Description of Artificial Sequence: Synthetic peptide
  c-term amidation

SEQ ID NO: 2667 - protein, 38 aa, Artificial Sequence; identical to SEQ ID NO: 2662
  Description of Artificial Sequence: Synthetic peptide
  n-term acetylation

SEQ ID NO: 2668 - protein, 38 aa, Artificial Sequence; identical to SEQ ID NO: 2662
  Description of Artificial Sequence: Synthetic peptide
  n-term acetylation
  c-term amidation

SEQ ID NO: 2669 - protein, 38 aa, Artificial Sequence; identical to SEQ ID NO: 2657
  Description of Artificial Sequence: Synthetic peptide
  c-term amidation

SEQ ID NO: 2670 - protein, 38 aa, Artificial Sequence; identical to SEQ ID NO: 2657
  Description of Artificial Sequence: Synthetic peptide
  n-term acetylation

SEQ ID NO: 2671 - protein, 38 aa, Artificial Sequence; identical to SEQ ID NO: 2657
  Description of Artificial Sequence: Synthetic peptide
  n-term acetylation
  c-term amidation

SEQ ID NO: 2672 - protein, 38 aa, Artificial Sequence; identical to SEQ ID NO: 2658
  Description of Artificial Sequence: Synthetic peptide
  n-term acetylation

SEQ ID NO: 2673 - protein, 38 aa, Artificial Sequence; identical to SEQ ID NO: 2658
  Description of Artificial Sequence: Synthetic peptide
  c-term amidation

SEQ ID NO: 2674 - protein, 38 aa, Artificial Sequence; identical to SEQ ID NO: 2658
  Description of Artificial Sequence: Synthetic peptide
  n-term acetylation
  c-term amidation

SEQ ID NO: 2675 - protein, 38 aa, Artificial Sequence; identical to SEQ ID NO: 2655
  Description of Artificial Sequence: Synthetic peptide
  c-term amidation

SEQ ID NO: 2676 - protein, 38 aa, Artificial Sequence; identical to SEQ ID NO: 2655
  Description of Artificial Sequence: Synthetic peptide
  n-term acetylation

SEQ ID NO: 2677 - protein, 38 aa, Artificial Sequence; identical to SEQ ID NO: 2655
  Description of Artificial Sequence: Synthetic peptide
  n-term acetylation
  c-term amidation

SEQ ID NO: 2678 - protein, 38 aa, Artificial Sequence; identical to SEQ ID NO: 2659
  Description of Artificial Sequence: Synthetic peptide
  c-term amidation

SEQ ID NO: 2679 - protein, 38 aa, Artificial Sequence; identical to SEQ ID NO: 2659
  Description of Artificial Sequence: Synthetic peptide
  n-term acetylation

SEQ ID NO: 2680 - protein, 38 aa, Artificial Sequence; identical to SEQ ID NO: 2659
  Description of Artificial Sequence: Synthetic peptide
  n-term acetylation
  c-term amidation

SEQ ID NO: 2681 - protein, 37 aa, Artificial Sequence
  Description of Artificial Sequence: Synthetic peptide
VIINVKCKISAQCLEPCKKAGMRFGKCANGKCHCTPK

SEQ ID NO: 2682 - protein, 37 aa, Artificial Sequence; identical to SEQ ID NO: 2681
  Description of Artificial Sequence: Synthetic peptide
  n-term acetylation

SEQ ID NO: 2683 - protein, 37 aa, Artificial Sequence; identical to SEQ ID NO: 2681
  Description of Artificial Sequence: Synthetic peptide
  c-term amidation

SEQ ID NO: 2684 - protein, 37 aa, Artificial Sequence; identical to SEQ ID NO: 2681
  Description of Artificial Sequence: Synthetic peptide
  n-term acetylation
  c-term amidation

SEQ ID NO: 2685 - protein, 38 aa, Artificial Sequence
  Description of Artificial Sequence: Synthetic peptide
GVIINVKCKISAQCLEPCKKAGMRFGKCANGKCACTPK

SEQ ID NO: 2686 - protein, 38 aa, Artificial Sequence; identical to SEQ ID NO: 2685
  Description of Artificial Sequence: Synthetic peptide
  n-term acetylation

SEQ ID NO: 2687 - protein, 38 aa, Artificial Sequence; identical to SEQ ID NO: 2685
  Description of Artificial Sequence: Synthetic peptide
  c-term amidation

SEQ ID NO: 2688 - protein, 38 aa, Artificial Sequence; identical to SEQ ID NO: 2685
  Description of Artificial Sequence: Synthetic peptide
  n-term acetylation
  c-term amidation

SEQ ID NO: 2689 - protein, 37 aa, Artificial Sequence
  Description of Artificial Sequence: Synthetic peptide
VIINVKCKISAQCLKPCKDAGMRFGKCANGKCHCTPK

SEQ ID NO: 2690 - protein, 37 aa, Artificial Sequence; identical to SEQ ID NO: 2689
  Description of Artificial Sequence: Synthetic peptide
  n-term acetylation

SEQ ID NO: 2691 - protein, 37 aa, Artificial Sequence; identical to SEQ ID NO: 2689
  Description of Artificial Sequence: Synthetic peptide
  c-term amidation

SEQ ID NO: 2692 - protein, 37 aa, Artificial Sequence; identical to SEQ ID NO: 2689
  Description of Artificial Sequence: Synthetic peptide
  n-term acetylation
  c-term amidation

SEQ ID NO: 2693 - protein, 34 aa, Artificial Sequence
  Description of Artificial Sequence: Synthetic peptide
NVKCKISAQCLKPCKDAGMRFGKCANGKCHCTPK

SEQ ID NO: 2694 - protein, 34 aa, Artificial Sequence; identical to SEQ ID NO: 2693
  Description of Artificial Sequence: Synthetic peptide
  n-term acetylation

SEQ ID NO: 2695 - protein, 34 aa, Artificial Sequence; identical to SEQ ID NO: 2693
  Description of Artificial Sequence: Synthetic peptide
  c-term amidation

SEQ ID NO: 2696 - protein, 34 aa, Artificial Sequence; identical to SEQ ID NO: 2693
  Description of Artificial Sequence: Synthetic peptide
  n-term acetylation
  c-term amidation

SEQ ID NO: 2697 - protein, 32 aa, Artificial Sequence
  Description of Artificial Sequence: Synthetic peptide
KCKISAQCLKPCKDAGMRFGKCANGKCHCTPK

SEQ ID NO: 2698 - protein, 32 aa, Artificial Sequence; identical to SEQ ID NO: 2697
  Description of Artificial Sequence: Synthetic peptide
  n-term acetylation

SEQ ID NO: 2699 - protein, 32 aa, Artificial Sequence; identical to SEQ ID NO: 2697
  Description of Artificial Sequence: Synthetic peptide
  c-term amidation

SEQ ID NO: 2700 - protein, 32 aa, Artificial Sequence; identical to SEQ ID NO: 2697
  Description of Artificial Sequence: Synthetic peptide
  n-term acetylation
  c-term amidation

SEQ ID NO: 2701 - protein, 31 aa, Artificial Sequence
  Description of Artificial Sequence: Synthetic peptide
CKISAQCLKPCKDAGMRFGKCANGKCHCTPK

SEQ ID NO: 2702 - protein, 31 aa, Artificial Sequence; identical to SEQ ID NO: 2701
  Description of Artificial Sequence: Synthetic peptide
  n-term acetylation

SEQ ID NO: 2703 - protein, 31 aa, Artificial Sequence; identical to SEQ ID NO: 2701
  Description of Artificial Sequence: Synthetic peptide
  c-term amidation

SEQ ID NO: 2704 - protein, 31 aa, Artificial Sequence; identical to SEQ ID NO: 2701
  Description of Artificial Sequence: Synthetic peptide
  n-term acetylation
  c-term amidation

SEQ ID NO: 2705 - protein, 38 aa, Artificial Sequence
  Description of Artificial Sequence: Synthetic peptide
GVIINVKCKISAQCLKPCKDAGMRNGKCANGKCHCTPK

SEQ ID NO: 2706 - protein, 38 aa, Artificial Sequence; identical to SEQ ID NO: 2705
  Description of Artificial Sequence: Synthetic peptide
  c-term amidation

SEQ ID NO: 2707 - protein, 38 aa, Artificial Sequence; identical to SEQ ID NO: 2705
  Description of Artificial Sequence: Synthetic peptide
  n-term acetylation

SEQ ID NO: 2708 - protein, 38 aa, Artificial Sequence; identical to SEQ ID NO: 2705
  Description of Artificial Sequence: Synthetic peptide
  n-term acetylation
  c-term amidation

SEQ ID NO: 2709 - protein, 38 aa, Artificial Sequence; identical to SEQ ID NO: 1952
  Description of Artificial Sequence: Synthetic peptide

SEQ ID NO: 2710 - protein, 38 aa, Artificial Sequence; identical to SEQ ID NO: 1952
  Description of Artificial Sequence: Synthetic peptide
  c-term amidation

SEQ ID NO: 2711 - protein, 38 aa, Artificial Sequence; identical to SEQ ID NO: 1952
  Description of Artificial Sequence: Synthetic peptide
  n-term acetylation

SEQ ID NO: 2712 - protein, 38 aa, Artificial Sequence; identical to SEQ ID NO: 1952
  Description of Artificial Sequence: Synthetic peptide
  n-term acetylation
  c-term amidation

SEQ ID NO: 2713 - protein, 38 aa, Artificial Sequence
  Description of Artificial Sequence: Synthetic peptide
GVIINVKCKISKQCLKPCRDAGMRFGKCANGKCHCTPK

SEQ ID NO: 2714 - protein, 38 aa, Artificial Sequence; identical to SEQ ID NO: 2713
  Description of Artificial Sequence: Synthetic peptide
  n-term acetylation

SEQ ID NO: 2715 - protein, 38 aa, Artificial Sequence; identical to SEQ ID NO: 2713
  Description of Artificial Sequence: Synthetic peptide
  c-term amidation

SEQ ID NO: 2716 - protein, 38 aa, Artificial Sequence; identical to SEQ ID NO: 2713
  Description of Artificial Sequence: Synthetic peptide
  n-term acetylation
  c-term amidation

SEQ ID NO: 2717 - protein, 37 aa, Artificial Sequence
  Description of Artificial Sequence: Synthetic peptide
TIINVKCKISAQCLKPCKDAGMRFGKCANGKCHCTPK

SEQ ID NO: 2718 - protein, 37 aa, Artificial Sequence; identical to SEQ ID NO: 2717
  Description of Artificial Sequence: Synthetic peptide
  n-term acetylation

SEQ ID NO: 2719 - protein, 37 aa, Artificial Sequence; identical to SEQ ID NO: 2717
  Description of Artificial Sequence: Synthetic peptide
  c-term amidation

SEQ ID NO: 2720 - protein, 37 aa, Artificial Sequence; identical to SEQ ID NO: 2717
  Description of Artificial Sequence: Synthetic peptide
  n-term acetylation
  c-term amidation

SEQ ID NO: 2721 - protein, 38 aa, Artificial Sequence
  Description of Artificial Sequence: Synthetic peptide
GVKINVKCKISAQCLEPCKKAGMRFGKCANGKCHCTPK

SEQ ID NO: 2722 - protein, 38 aa, Artificial Sequence; identical to SEQ ID NO: 2721
  Description of Artificial Sequence: Synthetic peptide
  n-term acetylation

SEQ ID NO: 2723 - protein, 38 aa, Artificial Sequence; identical to SEQ ID NO: 2721
  Description of Artificial Sequence: Synthetic peptide
  c-term amidation

SEQ ID NO: 2724 - protein, 38 aa, Artificial Sequence; identical to SEQ ID NO: 2721
  Description of Artificial Sequence: Synthetic peptide
  n-term acetylation
  c-term amidation

SEQ ID NO: 2725 - protein, 38 aa, Artificial Sequence
  Description of Artificial Sequence: Synthetic peptide
GVKINVKCKISAQCLEPCKKAGMRFGKCANGKCACTPK

SEQ ID NO: 2726 - protein, 38 aa, Artificial Sequence
  Description of Artificial Sequence: Synthetic peptide
GVKINVKCKISAQCLKPCKDAGMRFGKCANGKCHCTPK

SEQ ID NO: 2727 - protein, 38 aa, Artificial Sequence
  Description of Artificial Sequence: Synthetic peptide
GVKINVKCKISAQCLKPCKDAGMRFGKCANGKCACTPK

SEQ ID NO: 2728 - protein, 38 aa, Artificial Sequence; identical to SEQ ID NO: 2725
  Description of Artificial Sequence: Synthetic peptide
  n-term acetylation

SEQ ID NO: 2729 - protein, 38 aa, Artificial Sequence; identical to SEQ ID NO: 2725
  Description of Artificial Sequence: Synthetic peptide
  c-term amidation

SEQ ID NO: 2730 - protein, 38 aa, Artificial Sequence; identical to SEQ ID NO: 2725
  Description of Artificial Sequence: Synthetic peptide
  n-term acetylation
  c-term amidation

SEQ ID NO: 2731 - protein, 38 aa, Artificial Sequence; identical to SEQ ID NO: 2727
  Description of Artificial Sequence: Synthetic peptide
  n-term acetylation

SEQ ID NO: 2732 - protein, 38 aa, Artificial Sequence; identical to SEQ ID NO: 2727
  Description of Artificial Sequence: Synthetic peptide
  c-term amidation

SEQ ID NO: 2733 - protein, 38 aa, Artificial Sequence; identical to SEQ ID NO: 2727
  Description of Artificial Sequence: Synthetic peptide
  n-term acetylation
  c-term amidation

SEQ ID NO: 2734 - protein, 38 aa, Artificial Sequence; identical to SEQ ID NO: 2726
  Description of Artificial Sequence: Synthetic peptide
  n-term acetylation

SEQ ID NO: 2735 - protein, 38 aa, Artificial Sequence; identical to SEQ ID NO: 2726
  Description of Artificial Sequence: Synthetic peptide
  c-term amidation

SEQ ID NO: 2736 - protein, 38 aa, Artificial Sequence; identical to SEQ ID NO: 2726
  Description of Artificial Sequence: Synthetic peptide
  n-term acetylation
  c-term amidation

SEQ ID NO: 2737 - protein, 36 aa, Artificial Sequence
  Description of Artificial Sequence: Synthetic peptide
GVIINVKCKISAQCLKPCKDAGMRFGKCANGKCHCT

SEQ ID NO: 2738 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCHCTPK

SEQ ID NO: 2739 - protein, 38 aa, Artificial Sequence; identical to SEQ ID NO: 2738
  Description of Artificial Sequence: Synthetic peptide
  MOD_RES (16)..(16): hLys

SEQ ID NO: 2740 - protein, 38 aa, Artificial Sequence; identical to SEQ ID NO: 2738
  Description of Artificial Sequence: Synthetic peptide
  MOD_RES (16)..(16): hArg

SEQ ID NO: 2741 - protein, 38 aa, Artificial Sequence; identical to SEQ ID NO: 2738
  Description of Artificial Sequence: Synthetic peptide
  MOD_RES (16)..(16): Cit

SEQ ID NO: 2742 - protein, 38 aa, Artificial Sequence; identical to SEQ ID NO: 2738
  Description of Artificial Sequence: Synthetic peptide
  MOD_RES (16)..(16): hCit

SEQ ID NO: 2743 - protein, 38 aa, Artificial Sequence; identical to SEQ ID NO: 2738
  Description of Artificial Sequence: Synthetic peptide
  MOD_RES (16)..(16): Dpr

SEQ ID NO: 2744 - protein, 38 aa, Artificial Sequence; identical to SEQ ID NO: 2738
  Description of Artificial Sequence: Synthetic peptide
  MOD_RES (16)..(16): Dab

SEQ ID NO: 2745 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCHCYPK

SEQ ID NO: 2746 - protein, 38 aa, Artificial Sequence; identical to SEQ ID NO: 2745
  Description of Artificial Sequence: Synthetic peptide
  MOD_RES (16)..(16): hLys

SEQ ID NO: 2747 - protein, 38 aa, Artificial Sequence; identical to SEQ ID NO: 2745
  Description of Artificial Sequence: Synthetic peptide
  MOD_RES (16)..(16): hArg

SEQ ID NO: 2748 - protein, 38 aa, Artificial Sequence; identical to SEQ ID NO: 2745
  Description of Artificial Sequence: Synthetic peptide
  MOD_RES (16)..(16): Cit

SEQ ID NO: 2749 - protein, 38 aa, Artificial Sequence; identical to SEQ ID NO: 2745
  Description of Artificial Sequence: Synthetic peptide
  MOD_RES (16)..(16): hCit

SEQ ID NO: 2750 - protein, 38 aa, Artificial Sequence; identical to SEQ ID NO: 2745
  Description of Artificial Sequence: Synthetic peptide
  MOD_RES (16)..(16): Dpr

SEQ ID NO: 2751 - protein, 38 aa, Artificial Sequence; identical to SEQ ID NO: 2745
  Description of Artificial Sequence: Synthetic peptide
  MOD_RES (16)..(16): Dab

SEQ ID NO: 2752 - protein, 38 aa, Artificial Sequence
  Description of Artificial Sequence: Synthetic peptide
GVIINVKCKISAQCLKPCKDAGMRFGKCANGKCACYPK

SEQ ID NO: 2753 - protein, 38 aa, Artificial Sequence
  Description of Artificial Sequence: Synthetic peptide
GVIINVKCKISAQCLKPCKDAGMRFGKCANGKCGCYPK

SEQ ID NO: 2754 - protein, 38 aa, Artificial Sequence
  Description of Artificial Sequence: Synthetic peptide
GVIINVKCKISAQCLKPCKDAGMRFGKCANGKCACFPK

SEQ ID NO: 2755 - protein, 38 aa, Artificial Sequence
  Description of Artificial Sequence: Synthetic peptide
GVIINVKCKISAQCLKPCKDAGMRFGKCANGKCACWPK

SEQ ID NO: 2756 - protein, 38 aa, Artificial Sequence
  Description of Artificial Sequence: Synthetic peptide
GVIINVKCKISAQCLKPCKEAGMRFGKCANGKCACYPK

SEQ ID NO: 2757 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCACTPK

SEQ ID NO: 2758 - protein, 38 aa, Artificial Sequence; identical to SEQ ID NO: 2757
  Description of Artificial Sequence: Synthetic peptide
  MOD_RES (16)..(16): hLys

SEQ ID NO: 2759 - protein, 38 aa, Artificial Sequence; identical to SEQ ID NO: 2757
  Description of Artificial Sequence: Synthetic peptide
  MOD_RES (16)..(16): hArg

SEQ ID NO: 2760 - protein, 38 aa, Artificial Sequence; identical to SEQ ID NO: 2757
  Description of Artificial Sequence: Synthetic peptide
  MOD_RES (16)..(16): Cit

SEQ ID NO: 2761 - protein, 38 aa, Artificial Sequence; identical to SEQ ID NO: 2738
  Description of Artificial Sequence: Synthetic peptide
  MOD_RES (16)..(16): hCit

SEQ ID NO: 2762 - protein, 38 aa, Artificial Sequence; identical to SEQ ID NO: 2757
  Description of Artificial Sequence: Synthetic peptide
  MOD_RES (16)..(16): Dpr

SEQ ID NO: 2763 - protein, 38 aa, Artificial Sequence; identical to SEQ ID NO: 2757
  Description of Artificial Sequence: Synthetic peptide
  MOD_RES (16)..(16): Dab

SEQ ID NO: 2764 - protein, 35 aa, Artificial Sequence
  Description of Artificial Sequence: Synthetic peptide
  MOD_RES (16)..(16): Orn
GVIINVKCKISAQCLXPCKDAGMRFGKCANGKCHC

SEQ ID NO: 2765 - protein, 35 aa, Artificial Sequence; identical to SEQ ID NO: 2764
  Description of Artificial Sequence: Synthetic peptide
  MOD_RES (16)..(16): hLys

SEQ ID NO: 2766 - protein, 35 aa, Artificial Sequence; identical to SEQ ID NO: 2764
  Description of Artificial Sequence: Synthetic peptide
  MOD_RES (16)..(16): hArg

SEQ ID NO: 2767 - protein, 35 aa, Artificial Sequence; identical to SEQ ID NO: 2764
  Description of Artificial Sequence: Synthetic peptide
  MOD_RES (16)..(16): Cit

SEQ ID NO: 2768 - protein, 35 aa, Artificial Sequence; identical to SEQ ID NO: 2764
  Description of Artificial Sequence: Synthetic peptide
  MOD_RES (16)..(16): hCit

SEQ ID NO: 2769 - protein, 35 aa, Artificial Sequence; identical to SEQ ID NO: 2764
  Description of Artificial Sequence: Synthetic peptide
  MOD_RES (16)..(16): Dpr

SEQ ID NO: 2770 - protein, 35 aa, Artificial Sequence; identical to SEQ ID NO: 2764
  Description of Artificial Sequence: Synthetic peptide
  MOD_RES (16)..(16): Dab

SEQ ID NO: 2771 - protein, 35 aa, Artificial Sequence
  Description of Artificial Sequence: Synthetic peptide
  MOD_RES (16)..(16): Orn
GVIINVKCKISAQCLXPCKDAGMRFGKCANGKCAC

SEQ ID NO: 2772 - protein, 35 aa, Artificial Sequence; identical to SEQ ID NO: 2771
  Description of Artificial Sequence: Synthetic peptide
  MOD_RES (16)..(16): hLys

SEQ ID NO: 2773 - protein, 35 aa, Artificial Sequence; identical to SEQ ID NO: 2771
  Description of Artificial Sequence: Synthetic peptide
  MOD_RES (16)..(16): hArg

SEQ ID NO: 2774 - protein, 35 aa, Artificial Sequence; identical to SEQ ID NO: 2771
  Description of Artificial Sequence: Synthetic peptide
  MOD_RES (16)..(16): Cit

SEQ ID NO: 2775 - protein, 35 aa, Artificial Sequence; identical to SEQ ID NO: 2764
  Description of Artificial Sequence: Synthetic peptide
  MOD_RES (16)..(16): hCit

SEQ ID NO: 2776 - protein, 35 aa, Artificial Sequence; identical to SEQ ID NO: 2771
  Description of Artificial Sequence: Synthetic peptide
  MOD_RES (16)..(16): Dpr

SEQ ID NO: 2777 - protein, 35 aa, Artificial Sequence; identical to SEQ ID NO: 2771
  Description of Artificial Sequence: Synthetic peptide
  MOD_RES (16)..(16): Dab

SEQ ID NO: 2778 - protein, 38 aa, Artificial Sequence
  Description of Artificial Sequence: Synthetic peptide
GVIINVKCKISAQCLKPCKDAGMRFGKCANGKCGCYGG

SEQ ID NO: 2779 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCHCYGG

SEQ ID NO: 2780 - protein, 38 aa, Artificial Sequence; identical to SEQ ID NO: 2779
  Description of Artificial Sequence: Synthetic peptide
  MOD_RES (16)..(16): hLys

SEQ ID NO: 2781 - protein, 38 aa, Artificial Sequence; identical to SEQ ID NO: 2779
  Description of Artificial Sequence: Synthetic peptide
  MOD_RES (16)..(16): hArg

SEQ ID NO: 2782 - protein, 38 aa, Artificial Sequence; identical to SEQ ID NO: 2779
  Description of Artificial Sequence: Synthetic peptide
  MOD_RES (16)..(16): Cit

SEQ ID NO: 2783 - protein, 38 aa, Artificial Sequence; identical to SEQ ID NO: 2779
  Description of Artificial Sequence: Synthetic peptide
  MOD_RES (16)..(16): hCit

SEQ ID NO: 2784 - protein, 38 aa, Artificial Sequence; identical to SEQ ID NO: 2779
  Description of Artificial Sequence: Synthetic peptide
  MOD_RES (16)..(16): Dpr

SEQ ID NO: 2785 - protein, 38 aa, Artificial Sequence
  Description of Artificial Sequence: Synthetic peptide
GVIINVKCKISAQCLKPCKDAGMRFGKCANGKCACYGG

SEQ ID NO: 2786 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCACYGG

SEQ ID NO: 2787 - protein, 38 aa, Artificial Sequence; identical to SEQ ID NO: 2786
  Description of Artificial Sequence: Synthetic peptide
  MOD_RES (16)..(16): hLys

SEQ ID NO: 2788 - protein, 38 aa, Artificial Sequence; identical to SEQ ID NO: 2786
  Description of Artificial Sequence: Synthetic peptide
  MOD_RES (16)..(16): hArg

SEQ ID NO: 2789 - protein, 38 aa, Artificial Sequence; identical to SEQ ID NO: 2786
  Description of Artificial Sequence: Synthetic peptide
  MOD_RES (16)..(16): Cit

SEQ ID NO: 2790 - protein, 38 aa, Artificial Sequence; identical to SEQ ID NO: 2779
  Description of Artificial Sequence: Synthetic peptide
  MOD_RES (16)..(16): hCit

SEQ ID NO: 2791 - protein, 38 aa, Artificial Sequence; identical to SEQ ID NO: 2786
  Description of Artificial Sequence: Synthetic peptide
  MOD_RES (16)..(16): Dpr

SEQ ID NO: 2792 - protein, 38 aa, Artificial Sequence; identical to SEQ ID NO: 2786
  Description of Artificial Sequence: Synthetic peptide
  MOD_RES (16)..(16): Dab

SEQ ID NO: 2793 - protein, 37 aa, Artificial Sequence
  Description of Artificial Sequence: Synthetic peptide
GVIINVKCKISAQCLKPCKDAGMRFGKCANGKCACYG

SEQ ID NO: 2794 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCHCGGG

SEQ ID NO: 2795 - protein, 38 aa, Artificial Sequence; identical to SEQ ID NO: 2794
  Description of Artificial Sequence: Synthetic peptide
  MOD_RES (16)..(16): hLys

SEQ ID NO: 2796 - protein, 38 aa, Artificial Sequence; identical to SEQ ID NO: 2794
  Description of Artificial Sequence: Synthetic peptide
  MOD_RES (16)..(16): hArg

SEQ ID NO: 2797 - protein, 38 aa, Artificial Sequence; identical to SEQ ID NO: 2794
  Description of Artificial Sequence: Synthetic peptide
  MOD_RES (16)..(16): Cit

SEQ ID NO: 2798 - protein, 38 aa, Artificial Sequence; identical to SEQ ID NO: 2794
  Description of Artificial Sequence: Synthetic peptide
  MOD_RES (16)..(16): hCit

SEQ ID NO: 2799 - protein, 38 aa, Artificial Sequence; identical to SEQ ID NO: 2794
  Description of Artificial Sequence: Synthetic peptide
  MOD_RES (16)..(16): Dpr

SEQ ID NO: 2800 - protein, 38 aa, Artificial Sequence
  Description of Artificial Sequence: Synthetic peptide
GVIINVKCKISAQCLKPCKDAGMRFGKCANGKCACFGG

SEQ ID NO: 2801 - protein, 38 aa, Artificial Sequence
  Description of Artificial Sequence: Synthetic peptide
  MOD_RES (16)..(16): Orn
GVIINVKCKISAQCLXPCKDAGMRFGKCANGKCACGGG

SEQ ID NO: 2802 - protein, 38 aa, Artificial Sequence; identical to SEQ ID NO: 2801
  Description of Artificial Sequence: Synthetic peptide
  MOD_RES (16)..(16): hLys

SEQ ID NO: 2803 - protein, 38 aa, Artificial Sequence; identical to SEQ ID NO: 2801
  Description of Artificial Sequence: Synthetic peptide
  MOD_RES (16)..(16): hArg

SEQ ID NO: 2804 - protein, 38 aa, Artificial Sequence; identical to SEQ ID NO: 2801
  Description of Artificial Sequence: Synthetic peptide
  MOD_RES (16)..(16): Cit

SEQ ID NO: 2805 - protein, 38 aa, Artificial Sequence; identical to SEQ ID NO: 2801
  Description of Artificial Sequence: Synthetic peptide
  MOD_RES (16)..(16): hCit

SEQ ID NO: 2806 - protein, 38 aa, Artificial Sequence; identical to SEQ ID NO: 2801
  Description of Artificial Sequence: Synthetic peptide
  MOD_RES (16)..(16): Dpr

SEQ ID NO: 2807 - protein, 38 aa, Artificial Sequence; identical to SEQ ID NO: 2801
  Description of Artificial Sequence: Synthetic peptide
  MOD_RES (16)..(16): Dab

SEQ ID NO: 2808 - protein, 37 aa, Artificial Sequence
  Description of Artificial Sequence: Synthetic peptide
GVIINVKCKISAQCLKPCKDAGMRFGKCANGKCACGG

SEQ ID NO: 2809 - protein, 37 aa, Artificial Sequence; identical to SEQ ID NO: 2793
  Description of Artificial Sequence: Synthetic peptide

SEQ ID NO: 2810 - protein, 37 aa, Artificial Sequence
  Description of Artificial Sequence: Synthetic peptide
  MOD_RES (16)..(16): Orn
GVIINVKCKISAQCLXPCKDAGMRFGKCANGKCACGG

SEQ ID NO: 2811 - protein, 38 aa, Artificial Sequence
  Description of Artificial Sequence: Synthetic peptide
  MOD_RES (16)..(16): hLys
GVIINVKCKISAQCLXPCKEAGMRFGKCANGKCHCTPK

SEQ ID NO: 2812 - protein, 38 aa, Artificial Sequence; identical to SEQ ID NO: 2811
  Description of Artificial Sequence: Synthetic peptide
  MOD_RES (16)..(16): hArg

SEQ ID NO: 2813 - protein, 38 aa, Artificial Sequence; identical to SEQ ID NO: 2811
  Description of Artificial Sequence: Synthetic peptide
  MOD_RES (16)..(16): Cit

SEQ ID NO: 2814 - protein, 38 aa, Artificial Sequence; identical to SEQ ID NO: 2811
  Description of Artificial Sequence: Synthetic peptide
  MOD_RES (16)..(16): hCit

SEQ ID NO: 2815 - protein, 38 aa, Artificial Sequence; identical to SEQ ID NO: 2811
  Description of Artificial Sequence: Synthetic peptide
  MOD_RES (16)..(16): Dpr

SEQ ID NO: 2816 - protein, 38 aa, Artificial Sequence; identical to SEQ ID NO: 2811
  Description of Artificial Sequence: Synthetic peptide
  MOD_RES (16)..(16): Dab

SEQ ID NO: 2817 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCHCYPK

SEQ ID NO: 2818 - protein, 38 aa, Artificial Sequence; identical to SEQ ID NO: 2817
  Description of Artificial Sequence: Synthetic peptide
  MOD_RES (16)..(16): hLys

SEQ ID NO: 2819 - protein, 38 aa, Artificial Sequence; identical to SEQ ID NO: 2817
  Description of Artificial Sequence: Synthetic peptide
  MOD_RES (16)..(16): hArg

SEQ ID NO: 2820 - protein, 38 aa, Artificial Sequence; identical to SEQ ID NO: 2817
  Description of Artificial Sequence: Synthetic peptide
  MOD_RES (16)..(16): Cit

SEQ ID NO: 2821 - protein, 38 aa, Artificial Sequence; identical to SEQ ID NO: 2817
  Description of Artificial Sequence: Synthetic peptide
  MOD_RES (16)..(16): hCit

SEQ ID NO: 2822 - protein, 38 aa, Artificial Sequence; identical to SEQ ID NO: 2817
  Description of Artificial Sequence: Synthetic peptide
  MOD_RES (16)..(16): Dpr

SEQ ID NO: 2823 - protein, 38 aa, Artificial Sequence; identical to SEQ ID NO: 2817
  Description of Artificial Sequence: Synthetic peptide
  MOD_RES (16)..(16): Dab

SEQ ID NO: 2824 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCACTPK

SEQ ID NO: 2825 - protein, 38 aa, Artificial Sequence; identical to SEQ ID NO: 2824
  Description of Artificial Sequence: Synthetic peptide
  MOD_RES (16)..(16): hLys

SEQ ID NO: 2826 - protein, 38 aa, Artificial Sequence; identical to SEQ ID NO: 2824
  Description of Artificial Sequence: Synthetic peptide
  MOD_RES (16)..(16): hArg

SEQ ID NO: 2827 - protein, 38 aa, Artificial Sequence; identical to SEQ ID NO: 2824
  Description of Artificial Sequence: Synthetic peptide
  MOD_RES (16)..(16): Cit

SEQ ID NO: 2828 - protein, 38 aa, Artificial Sequence; identical to SEQ ID NO: 2811
  Description of Artificial Sequence: Synthetic peptide
  MOD_RES (16)..(16): hCit

SEQ ID NO: 2829 - protein, 38 aa, Artificial Sequence; identical to SEQ ID NO: 2824
  Description of Artificial Sequence: Synthetic peptide
  MOD_RES (16)..(16): Dpr

SEQ ID NO: 2830 - protein, 38 aa, Artificial Sequence; identical to SEQ ID NO: 2824
  Description of Artificial Sequence: Synthetic peptide
  MOD_RES (16)..(16): Dab

SEQ ID NO: 2831 - protein, 35 aa, Artificial Sequence
  Description of Artificial Sequence: Synthetic peptide
  MOD_RES (16)..(16): Orn
GVIINVKCKISAQCLXPCKEAGMRFGKCANGKCHC

SEQ ID NO: 2832 - protein, 35 aa, Artificial Sequence; identical to SEQ ID NO: 2831
  Description of Artificial Sequence: Synthetic peptide
  MOD_RES (16)..(16): hLys

SEQ ID NO: 2833 - protein, 35 aa, Artificial Sequence; identical to SEQ ID NO: 2831
  Description of Artificial Sequence: Synthetic peptide
  MOD_RES (16)..(16): hArg

SEQ ID NO: 2834 - protein, 35 aa, Artificial Sequence; identical to SEQ ID NO: 2831
  Description of Artificial Sequence: Synthetic peptide
  MOD_RES (16)..(16): Cit

SEQ ID NO: 2835 - protein, 35 aa, Artificial Sequence; identical to SEQ ID NO: 2831
  Description of Artificial Sequence: Synthetic peptide
  MOD_RES (16)..(16): hCit

SEQ ID NO: 2836 - protein, 35 aa, Artificial Sequence; identical to SEQ ID NO: 2831
  Description of Artificial Sequence: Synthetic peptide
  MOD_RES (16)..(16): Dpr

SEQ ID NO: 2837 - protein, 35 aa, Artificial Sequence
  Description of Artificial Sequence: Synthetic peptide
  MOD_RES (16)..(16): Orn
GVIINVKCKISAQCLXPCKEAGMRFGKCANGKCAC

SEQ ID NO: 2838 - protein, 35 aa, Artificial Sequence; identical to SEQ ID NO: 2837
  Description of Artificial Sequence: Synthetic peptide
  MOD_RES (16)..(16): hLys

SEQ ID NO: 2839 - protein, 35 aa, Artificial Sequence; identical to SEQ ID NO: 2837
  Description of Artificial Sequence: Synthetic peptide
  MOD_RES (16)..(16): hArg

SEQ ID NO: 2840 - protein, 35 aa, Artificial Sequence; identical to SEQ ID NO: 2837
  Description of Artificial Sequence: Synthetic peptide
  MOD_RES (16)..(16): Cit

SEQ ID NO: 2841 - protein, 35 aa, Artificial Sequence; identical to SEQ ID NO: 2831
  Description of Artificial Sequence: Synthetic peptide
  MOD_RES (16)..(16): hCit

SEQ ID NO: 2842 - protein, 35 aa, Artificial Sequence; identical to SEQ ID NO: 2837
  Description of Artificial Sequence: Synthetic peptide
  MOD_RES (16)..(16): Dpr

SEQ ID NO: 2843 - protein, 35 aa, Artificial Sequence; identical to SEQ ID NO: 2837
  Description of Artificial Sequence: Synthetic peptide
  MOD_RES (16)..(16): Dab

SEQ ID NO: 2844 - protein, 38 aa, Artificial Sequence
  Description of Artificial Sequence: Synthetic peptide
GVIINVKCKISAQCLKPCKEAGMRFGKCANGKCHCYGG

SEQ ID NO: 2845 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCHCYGG

SEQ ID NO: 2846 - protein, 37 aa, Artificial Sequence
  Description of Artificial Sequence: Synthetic peptide
GVIINVKCKISAQCLKPCKEAGMRFGKCANGKCHCYG

SEQ ID NO: 2847 - protein, 37 aa, Artificial Sequence
  Description of Artificial Sequence: Synthetic peptide
GVIINVKCKISAQCLKPCKEAGMRFGKCANGKCACYG

SEQ ID NO: 2848 - protein, 38 aa, Artificial Sequence; identical to SEQ ID NO: 2845
  Description of Artificial Sequence: Synthetic peptide
  MOD_RES (16)..(16): hLys

SEQ ID NO: 2849 - protein, 38 aa, Artificial Sequence; identical to SEQ ID NO: 2845
  Description of Artificial Sequence: Synthetic peptide
  MOD_RES (16)..(16): hArg

SEQ ID NO: 2850 - protein, 38 aa, Artificial Sequence; identical to SEQ ID NO: 2845
  Description of Artificial Sequence: Synthetic peptide
  MOD_RES (16)..(16): Cit

SEQ ID NO: 2851 - protein, 38 aa, Artificial Sequence; identical to SEQ ID NO: 2845
  Description of Artificial Sequence: Synthetic peptide
  MOD_RES (16)..(16): hCit

SEQ ID NO: 2852 - protein, 38 aa, Artificial Sequence; identical to SEQ ID NO: 2845
  Description of Artificial Sequence: Synthetic peptide
  MOD_RES (16)..(16): Dpr

SEQ ID NO: 2853 - protein, 38 aa, Artificial Sequence; identical to SEQ ID NO: 2845
  Description of Artificial Sequence: Synthetic peptide
  MOD_RES (16)..(16): Dab

SEQ ID NO: 2854 - protein, 37 aa, Artificial Sequence; identical to SEQ ID NO: 2847
  Description of Artificial Sequence: Synthetic peptide

SEQ ID NO: 2855 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCACYGG

SEQ ID NO: 2856 - protein, 38 aa, Artificial Sequence; identical to SEQ ID NO: 2855
  Description of Artificial Sequence: Synthetic peptide
  MOD_RES (16)..(16): hLys

SEQ ID NO: 2857 - protein, 38 aa, Artificial Sequence; identical to SEQ ID NO: 2855
  Description of Artificial Sequence: Synthetic peptide
  MOD_RES (16)..(16): hArg

SEQ ID NO: 2858 - protein, 38 aa, Artificial Sequence; identical to SEQ ID NO: 2855
  Description of Artificial Sequence: Synthetic peptide
  MOD_RES (16)..(16): Cit

SEQ ID NO: 2859 - protein, 38 aa, Artificial Sequence; identical to SEQ ID NO: 2845
  Description of Artificial Sequence: Synthetic peptide
  MOD_RES (16)..(16): hCit

SEQ ID NO: 2860 - protein, 38 aa, Artificial Sequence; identical to SEQ ID NO: 2855
  Description of Artificial Sequence: Synthetic peptide
  MOD_RES (16)..(16): Dpr

SEQ ID NO: 2861 - protein, 38 aa, Artificial Sequence; identical to SEQ ID NO: 2855
  Description of Artificial Sequence: Synthetic peptide
  MOD_RES (16)..(16): Dab

SEQ ID NO: 2862 - protein, 38 aa, Artificial Sequence
  Description of Artificial Sequence: Synthetic peptide
GVIINVKCKISAQCLKPCKEAGMRFGKCANGKCACFGG

SEQ ID NO: 2863 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCHCGGG

SEQ ID NO: 2864 - protein, 38 aa, Artificial Sequence; identical to SEQ ID NO: 2863
  Description of Artificial Sequence: Synthetic peptide
  MOD_RES (16)..(16): hLys

SEQ ID NO: 2865 - protein, 38 aa, Artificial Sequence; identical to SEQ ID NO: 2863
  Description of Artificial Sequence: Synthetic peptide
  MOD_RES (16)..(16): hArg

SEQ ID NO: 2866 - protein, 38 aa, Artificial Sequence; identical to SEQ ID NO: 2863
  Description of Artificial Sequence: Synthetic peptide
  MOD_RES (16)..(16): Cit

SEQ ID NO: 2867 - protein, 38 aa, Artificial Sequence; identical to SEQ ID NO: 2863
  Description of Artificial Sequence: Synthetic peptide
  MOD_RES (16)..(16): hCit

SEQ ID NO: 2868 - protein, 38 aa, Artificial Sequence; identical to SEQ ID NO: 2863
  Description of Artificial Sequence: Synthetic peptide
  MOD_RES (16)..(16): Dpr

SEQ ID NO: 2869 - protein, 38 aa, Artificial Sequence
  Description of Artificial Sequence: Synthetic peptide
  MOD_RES (16)..(16): Orn
GVIINVKCKISAQCLXPCKEAGMRFGKCANGKCACGGG

SEQ ID NO: 2870 - protein, 38 aa, Artificial Sequence; identical to SEQ ID NO: 2869
  Description of Artificial Sequence: Synthetic peptide
  MOD_RES (16)..(16): hLys

SEQ ID NO: 2871 - protein, 38 aa, Artificial Sequence; identical to SEQ ID NO: 2869
  Description of Artificial Sequence: Synthetic peptide
  MOD_RES (16)..(16): hArg

SEQ ID NO: 2872 - protein, 38 aa, Artificial Sequence; identical to SEQ ID NO: 2869
  Description of Artificial Sequence: Synthetic peptide
  MOD_RES (16)..(16): Cit

SEQ ID NO: 2873 - protein, 37 aa, Artificial Sequence
  Description of Artificial Sequence: Synthetic peptide
  MOD_RES (16)..(16): hCit
GVIINVKCKISAQCLXPCKEAGMRFGKCANGKCACTP

SEQ ID NO: 2874 - protein, 37 aa, Artificial Sequence; identical to SEQ ID NO: 2873
  Description of Artificial Sequence: Synthetic peptide
  MOD_RES (16)..(16): Dpr

SEQ ID NO: 2875 - protein, 37 aa, Artificial Sequence; identical to SEQ ID NO: 2873
  Description of Artificial Sequence: Synthetic peptide
  MOD_RES (16)..(16): Dab

SEQ ID NO: 2876 - protein, 38 aa, Artificial Sequence; identical to SEQ ID NO: 2738
  Description of Artificial Sequence: Synthetic peptide
  MOD_RES (16)..(16): Orn
  c-term amidation

SEQ ID NO: 2877 - protein, 38 aa, Artificial Sequence; identical to SEQ ID NO: 2738
  Description of Artificial Sequence: Synthetic peptide
  MOD_RES (16)..(16): hLys
  c-term amidation

SEQ ID NO: 2878 - protein, 38 aa, Artificial Sequence; identical to SEQ ID NO: 2738
  Description of Artificial Sequence: Synthetic peptide
  MOD_RES (16)..(16): hArg
  c-term amidation

SEQ ID NO: 2879 - protein, 38 aa, Artificial Sequence; identical to SEQ ID NO: 2738
  Description of Artificial Sequence: Synthetic peptide
  MOD_RES (16)..(16): Cit
  c-term amidation

SEQ ID NO: 2880 - protein, 38 aa, Artificial Sequence; identical to SEQ ID NO: 2738
  Description of Artificial Sequence: Synthetic peptide
  MOD_RES (16)..(16): hCit
  c-term amidation

SEQ ID NO: 2881 - protein, 38 aa, Artificial Sequence; identical to SEQ ID NO: 2738
  Description of Artificial Sequence: Synthetic peptide
  MOD_RES (16)..(16): Dpr
  c-term amidation

SEQ ID NO: 2882 - protein, 38 aa, Artificial Sequence; identical to SEQ ID NO: 2738
  Description of Artificial Sequence: Synthetic peptide
  MOD_RES (16)..(16): Dab
  c-term amidation

SEQ ID NO: 2883 - protein, 38 aa, Artificial Sequence; identical to SEQ ID NO: 2745
  Description of Artificial Sequence: Synthetic peptide
  MOD_RES (16)..(16): Orn
  c-term amidation

SEQ ID NO: 2884 - protein, 38 aa, Artificial Sequence; identical to SEQ ID NO: 2745
  Description of Artificial Sequence: Synthetic peptide
  MOD_RES (16)..(16): hLys
  c-term amidation

SEQ ID NO: 2885 - protein, 38 aa, Artificial Sequence; identical to SEQ ID NO: 2745
  Description of Artificial Sequence: Synthetic peptide
  MOD_RES (16)..(16): hArg
  c-term amidation

SEQ ID NO: 2886 - protein, 38 aa, Artificial Sequence; identical to SEQ ID NO: 2745
  Description of Artificial Sequence: Synthetic peptide
  MOD_RES (16)..(16): Cit
  c-term amidation

SEQ ID NO: 2887 - protein, 38 aa, Artificial Sequence; identical to SEQ ID NO: 2745
  Description of Artificial Sequence: Synthetic peptide
  MOD_RES (16)..(16): hCit
  c-term amidation

SEQ ID NO: 2888 - protein, 38 aa, Artificial Sequence; identical to SEQ ID NO: 2745
  Description of Artificial Sequence: Synthetic peptide
  MOD_RES (16)..(16): Dpr
  c-term amidation

SEQ ID NO: 2889 - protein, 38 aa, Artificial Sequence; identical to SEQ ID NO: 2745
  Description of Artificial Sequence: Synthetic peptide
  MOD_RES (16)..(16): Dab
  c-term amidation

SEQ ID NO: 2890 - protein, 38 aa, Artificial Sequence; identical to SEQ ID NO: 2757
  Description of Artificial Sequence: Synthetic peptide
  MOD_RES (16)..(16): Orn
  c-term amidation

SEQ ID NO: 2891 - protein, 38 aa, Artificial Sequence; identical to SEQ ID NO: 2757
  Description of Artificial Sequence: Synthetic peptide
  MOD_RES (16)..(16): hLys
  c-term amidation

SEQ ID NO: 2892 - protein, 38 aa, Artificial Sequence; identical to SEQ ID NO: 2757
  Description of Artificial Sequence: Synthetic peptide
  MOD_RES (16)..(16): hArg
  c-term amidation

SEQ ID NO: 2893 - protein, 38 aa, Artificial Sequence; identical to SEQ ID NO: 2757
  Description of Artificial Sequence: Synthetic peptide
  MOD_RES (16)..(16): Cit
  c-term amidation

SEQ ID NO: 2894 - protein, 38 aa, Artificial Sequence; identical to SEQ ID NO: 2757
  Description of Artificial Sequence: Synthetic peptide
  MOD_RES (16)..(16): hCit
  c-term amidation

SEQ ID NO: 2895 - protein, 38 aa, Artificial Sequence; identical to SEQ ID NO: 2757
  Description of Artificial Sequence: Synthetic peptide
  MOD_RES (16)..(16): Dpr
  c-term amidation

SEQ ID NO: 2896 - protein, 38 aa, Artificial Sequence; identical to SEQ ID NO: 2757
  Description of Artificial Sequence: Synthetic peptide
  MOD_RES (16)..(16): Dab
  c-term amidation

SEQ ID NO: 2897 - protein, 35 aa, Artificial Sequence; identical to SEQ ID NO: 2764
  Description of Artificial Sequence: Synthetic peptide
  MOD_RES (16)..(16): Orn
  c-term amidation

SEQ ID NO: 2898 - protein, 35 aa, Artificial Sequence; identical to SEQ ID NO: 2764
  Description of Artificial Sequence: Synthetic peptide
  MOD_RES (16)..(16): hLys
  c-term amidation

SEQ ID NO: 2899 - protein, 35 aa, Artificial Sequence; identical to SEQ ID NO: 2764
  Description of Artificial Sequence: Synthetic peptide
  MOD_RES (16)..(16): hArg
  c-term amidation

SEQ ID NO: 2900 - protein, 35 aa, Artificial Sequence; identical to SEQ ID NO: 2764
  Description of Artificial Sequence: Synthetic peptide
  MOD_RES (16)..(16): Cit
  c-term amidation

SEQ ID NO: 2901 - protein, 35 aa, Artificial Sequence; identical to SEQ ID NO: 2764
  Description of Artificial Sequence: Synthetic peptide
  MOD_RES (16)..(16): hCit
  c-term amidation

SEQ ID NO: 2902 - protein, 35 aa, Artificial Sequence; identical to SEQ ID NO: 2764
  Description of Artificial Sequence: Synthetic peptide
  MOD_RES (16)..(16): Dpr
  c-term amidation

SEQ ID NO: 2903 - protein, 33 aa, Artificial Sequence
  Description of Artificial Sequence: Synthetic peptide
  MOD_RES (16)..(16): Orn
  c-term amidation
GVIINVKCKISAQCLXPCKDAGMRFGKCANGKC

SEQ ID NO: 2904 - protein, 33 aa, Artificial Sequence; identical to SEQ ID NO: 2903
  Description of Artificial Sequence: Synthetic peptide
  MOD_RES (16)..(16): hLys
  c-term amidation

SEQ ID NO: 2905 - protein, 33 aa, Artificial Sequence; identical to SEQ ID NO: 2903
  Description of Artificial Sequence: Synthetic peptide
  MOD_RES (16)..(16): hArg
  c-term amidation

SEQ ID NO: 2906 - protein, 33 aa, Artificial Sequence; identical to SEQ ID NO: 2903
  Description of Artificial Sequence: Synthetic peptide
  MOD_RES (16)..(16): Cit
  c-term amidation

SEQ ID NO: 2907 - protein, 35 aa, Artificial Sequence; identical to SEQ ID NO: 2764
  Description of Artificial Sequence: Synthetic peptide
  MOD_RES (16)..(16): hCit
  c-term amidation

SEQ ID NO: 2908 - protein, 33 aa, Artificial Sequence; identical to SEQ ID NO: 2903
  Description of Artificial Sequence: Synthetic peptide
  MOD_RES (16)..(16): Dpr
  c-term amidation

SEQ ID NO: 2909 - protein, 33 aa, Artificial Sequence; identical to SEQ ID NO: 2903
  Description of Artificial Sequence: Synthetic peptide
  MOD_RES (16)..(16): Dab
  c-term amidation

SEQ ID NO: 2910 - protein, 38 aa, Artificial Sequence
  Description of Artificial Sequence: Synthetic peptide
  c-term amidation
GVIINVKCKISAQCLKPCKDAGMRFGKCANGKCHCYGG

SEQ ID NO: 2911 - protein, 38 aa, Artificial Sequence; identical to SEQ ID NO: 2779
  Description of Artificial Sequence: Synthetic peptide
  MOD_RES (16)..(16): Orn
  c-term amidation

SEQ ID NO: 2912 - protein, 38 aa, Artificial Sequence; identical to SEQ ID NO: 2779
  Description of Artificial Sequence: Synthetic peptide
  MOD_RES (16)..(16): hLys
  c-term amidation

SEQ ID NO: 2913 - protein, 38 aa, Artificial Sequence; identical to SEQ ID NO: 2779
  Description of Artificial Sequence: Synthetic peptide
  MOD_RES (16)..(16): hArg
  c-term amidation

SEQ ID NO: 2914 - protein, 38 aa, Artificial Sequence; identical to SEQ ID NO: 2779
  Description of Artificial Sequence: Synthetic peptide
  MOD_RES (16)..(16): Cit
  c-term amidation

SEQ ID NO: 2915 - protein, 38 aa, Artificial Sequence; identical to SEQ ID NO: 2779
  Description of Artificial Sequence: Synthetic peptide
  MOD_RES (16)..(16): hCit
  c-term amidation

SEQ ID NO: 2916 - protein, 38 aa, Artificial Sequence; identical to SEQ ID NO: 2779
  Description of Artificial Sequence: Synthetic peptide
  MOD_RES (16)..(16): Dpr
  c-term amidation

SEQ ID NO: 2917 - protein, 38 aa, Artificial Sequence
  Description of Artificial Sequence: Synthetic peptide
  c-term amidation
GVIINVKCKISAQCLKPCKDAGMRFGKCANGKCHCFGG

SEQ ID NO: 2918 - protein, 37 aa, Artificial Sequence
  Description of Artificial Sequence: Synthetic peptide
  c-term amidation
GVIINVKCKISAQCLKPCKDAGMRFGKCANGKCHCYG

SEQ ID NO: 2919 - protein, 37 aa, Artificial Sequence; identical to SEQ ID NO: 2793
  Description of Artificial Sequence: Synthetic peptide
  c-term amidation

SEQ ID NO: 2920 - protein, 38 aa, Artificial Sequence; identical to SEQ ID NO: 2786
  Description of Artificial Sequence: Synthetic peptide
  MOD_RES (16)..(16): Orn
  c-term amidation

SEQ ID NO: 2921 - protein, 38 aa, Artificial Sequence; identical to SEQ ID NO: 2786
  Description of Artificial Sequence: Synthetic peptide
  MOD_RES (16)..(16): hLys
  c-term amidation

SEQ ID NO: 2922 - protein, 38 aa, Artificial Sequence; identical to SEQ ID NO: 2786
  Description of Artificial Sequence: Synthetic peptide
  MOD_RES (16)..(16): hArg
  c-term amidation

SEQ ID NO: 2923 - protein, 38 aa, Artificial Sequence; identical to SEQ ID NO: 2786
  Description of Artificial Sequence: Synthetic peptide
  MOD_RES (16)..(16): Cit
  c-term amidation

SEQ ID NO: 2924 - protein, 38 aa, Artificial Sequence; identical to SEQ ID NO: 2786
  Description of Artificial Sequence: Synthetic peptide
  MOD_RES (16)..(16): hCit
  c-term amidation

SEQ ID NO: 2925 - protein, 38 aa, Artificial Sequence; identical to SEQ ID NO: 2786
  Description of Artificial Sequence: Synthetic peptide
  MOD_RES (16)..(16): Dpr
  c-term amidation

SEQ ID NO: 2926 - protein, 38 aa, Artificial Sequence; identical to SEQ ID NO: 2786
  Description of Artificial Sequence: Synthetic peptide
  MOD_RES (16)..(16): Dab
  c-term amidation

SEQ ID NO: 2927 - protein, 38 aa, Artificial Sequence; identical to SEQ ID NO: 2785
  Description of Artificial Sequence: Synthetic peptide
  c-term amidation

SEQ ID NO: 2928 - protein, 38 aa, Artificial Sequence; identical to SEQ ID NO: 2794
  Description of Artificial Sequence: Synthetic peptide
  MOD_RES (16)..(16): Orn
  c-term amidation

SEQ ID NO: 2929 - protein, 38 aa, Artificial Sequence; identical to SEQ ID NO: 2794
  Description of Artificial Sequence: Synthetic peptide
  MOD_RES (16)..(16): hLys
  c-term amidation

SEQ ID NO: 2930 - protein, 38 aa, Artificial Sequence; identical to SEQ ID NO: 2794
  Description of Artificial Sequence: Synthetic peptide
  MOD_RES (16)..(16): hArg
  c-term amidation

SEQ ID NO: 2931 - protein, 38 aa, Artificial Sequence; identical to SEQ ID NO: 2794
  Description of Artificial Sequence: Synthetic peptide
  MOD_RES (16)..(16): Cit
  c-term amidation

SEQ ID NO: 2932 - protein, 38 aa, Artificial Sequence; identical to SEQ ID NO: 2794
  Description of Artificial Sequence: Synthetic peptide
  MOD_RES (16)..(16): hCit
  c-term amidation

SEQ ID NO: 2933 - protein, 38 aa, Artificial Sequence; identical to SEQ ID NO: 2794
  Description of Artificial Sequence: Synthetic peptide
  MOD_RES (16)..(16): Dpr
  c-term amidation

SEQ ID NO: 2934 - protein, 38 aa, Artificial Sequence
  Description of Artificial Sequence: Synthetic peptide
  c-term amidation
GVIINVKCKISAQCLKPCKDAGMRFGKCANGKCACGGG

SEQ ID NO: 2935 - protein, 38 aa, Artificial Sequence
  Description of Artificial Sequence: Synthetic peptide
  MOD_RES (16)..(16): Orn
  c-term amidation
GVIINVKCKISAQCLXPCKDAGMRFGKCANGKCACFGG

SEQ ID NO: 2936 - protein, 38 aa, Artificial Sequence; identical to SEQ ID NO: 2801
  Description of Artificial Sequence: Synthetic peptide
  MOD_RES (16)..(16): Orn
  c-term amidation

SEQ ID NO: 2937 - protein, 38 aa, Artificial Sequence; identical to SEQ ID NO: 2801
  Description of Artificial Sequence: Synthetic peptide
  MOD_RES (16)..(16): hLys
  c-term amidation

SEQ ID NO: 2938 - protein, 38 aa, Artificial Sequence; identical to SEQ ID NO: 2801
  Description of Artificial Sequence: Synthetic peptide
  MOD_RES (16)..(16): hArg
  c-term amidation

SEQ ID NO: 2939 - protein, 38 aa, Artificial Sequence; identical to SEQ ID NO: 2801
  Description of Artificial Sequence: Synthetic peptide
  MOD_RES (16)..(16): Cit
  c-term amidation

SEQ ID NO: 2940 - protein, 38 aa, Artificial Sequence; identical to SEQ ID NO: 2801
  Description of Artificial Sequence: Synthetic peptide
  MOD_RES (16)..(16): hCit
  c-term amidation

SEQ ID NO: 2941 - protein, 38 aa, Artificial Sequence; identical to SEQ ID NO: 2801
  Description of Artificial Sequence: Synthetic peptide
  MOD_RES (16)..(16): Dpr
  c-term amidation

SEQ ID NO: 2942 - protein, 38 aa, Artificial Sequence; identical to SEQ ID NO: 2801
  Description of Artificial Sequence: Synthetic peptide
  MOD_RES (16)..(16): Dab
  c-term amidation

SEQ ID NO: 2943 - protein, 38 aa, Artificial Sequence; identical to SEQ ID NO: 2811
  Description of Artificial Sequence: Synthetic peptide
  MOD_RES (16)..(16): Orn
  c-term amidation

SEQ ID NO: 2944 - protein, 38 aa, Artificial Sequence; identical to SEQ ID NO: 2811
  Description of Artificial Sequence: Synthetic peptide
  MOD_RES (16)..(16): hLys
  c-term amidation

SEQ ID NO: 2945 - protein, 38 aa, Artificial Sequence; identical to SEQ ID NO: 2811
  Description of Artificial Sequence: Synthetic peptide
  MOD_RES (16)..(16): hArg
  c-term amidation

SEQ ID NO: 2946 - protein, 38 aa, Artificial Sequence; identical to SEQ ID NO: 2811
  Description of Artificial Sequence: Synthetic peptide
  MOD_RES (16)..(16): Cit
  c-term amidation

SEQ ID NO: 2947 - protein, 38 aa, Artificial Sequence; identical to SEQ ID NO: 2811
  Description of Artificial Sequence: Synthetic peptide
  MOD_RES (16)..(16): hCit
  c-term amidation

SEQ ID NO: 2948 - protein, 38 aa, Artificial Sequence; identical to SEQ ID NO: 2811
  Description of Artificial Sequence: Synthetic peptide
  MOD_RES (16)..(16): Dpr
  c-term amidation

SEQ ID NO: 2949 - protein, 38 aa, Artificial Sequence; identical to SEQ ID NO: 2811
  Description of Artificial Sequence: Synthetic peptide
  MOD_RES (16)..(16): Dab
  c-term amidation

SEQ ID NO: 2950 - protein, 38 aa, Artificial Sequence; identical to SEQ ID NO: 2817
  Description of Artificial Sequence: Synthetic peptide
  MOD_RES (16)..(16): Orn
  c-term amidation

SEQ ID NO: 2951 - protein, 38 aa, Artificial Sequence; identical to SEQ ID NO: 2817
  Description of Artificial Sequence: Synthetic peptide
  MOD_RES (16)..(16): hLys
  c-term amidation

SEQ ID NO: 2952 - protein, 38 aa, Artificial Sequence; identical to SEQ ID NO: 2817
  Description of Artificial Sequence: Synthetic peptide
  MOD_RES (16)..(16): hArg
  c-term amidation

SEQ ID NO: 2953 - protein, 38 aa, Artificial Sequence; identical to SEQ ID NO: 2817
  Description of Artificial Sequence: Synthetic peptide
  MOD_RES (16)..(16): Cit
  c-term amidation

SEQ ID NO: 2954 - protein, 38 aa, Artificial Sequence; identical to SEQ ID NO: 2817
  Description of Artificial Sequence: Synthetic peptide
  MOD_RES (16)..(16): hCit
  c-term amidation

SEQ ID NO: 2955 - protein, 38 aa, Artificial Sequence; identical to SEQ ID NO: 2817
  Description of Artificial Sequence: Synthetic peptide
  MOD_RES (16)..(16): Dpr
  c-term amidation

SEQ ID NO: 2956 - protein, 38 aa, Artificial Sequence; identical to SEQ ID NO: 2817
  Description of Artificial Sequence: Synthetic peptide
  MOD_RES (16)..(16): Dab
  c-term amidation

SEQ ID NO: 2957 - protein, 38 aa, Artificial Sequence; identical to SEQ ID NO: 2824
  Description of Artificial Sequence: Synthetic peptide
  MOD_RES (16)..(16): Orn
  c-term amidation

SEQ ID NO: 2958 - protein, 38 aa, Artificial Sequence; identical to SEQ ID NO: 2824
  Description of Artificial Sequence: Synthetic peptide
  MOD_RES (16)..(16): hLys
  c-term amidation

SEQ ID NO: 2959 - protein, 38 aa, Artificial Sequence; identical to SEQ ID NO: 2824
  Description of Artificial Sequence: Synthetic peptide
  MOD_RES (16)..(16): hArg
  c-term amidation

SEQ ID NO: 2960 - protein, 38 aa, Artificial Sequence; identical to SEQ ID NO: 2824
  Description of Artificial Sequence: Synthetic peptide
  MOD_RES (16)..(16): Cit
  c-term amidation

SEQ ID NO: 2961 - protein, 38 aa, Artificial Sequence; identical to SEQ ID NO: 2824
  Description of Artificial Sequence: Synthetic peptide
  MOD_RES (16)..(16): hCit
  c-term amidation

SEQ ID NO: 2962 - protein, 38 aa, Artificial Sequence; identical to SEQ ID NO: 2824
  Description of Artificial Sequence: Synthetic peptide
  MOD_RES (16)..(16): Dpr
  c-term amidation

SEQ ID NO: 2963 - protein, 38 aa, Artificial Sequence; identical to SEQ ID NO: 2824
  Description of Artificial Sequence: Synthetic peptide
  MOD_RES (16)..(16): Dab
  c-term amidation

SEQ ID NO: 2964 - protein, 35 aa, Artificial Sequence; identical to SEQ ID NO: 2831
  Description of Artificial Sequence: Synthetic peptide
  MOD_RES (16)..(16): Orn
  c-term amidation

SEQ ID NO: 2965 - protein, 35 aa, Artificial Sequence; identical to SEQ ID NO: 2831
  Description of Artificial Sequence: Synthetic peptide
  MOD_RES (16)..(16): hLys
  c-term amidation

SEQ ID NO: 2966 - protein, 35 aa, Artificial Sequence; identical to SEQ ID NO: 2831
  Description of Artificial Sequence: Synthetic peptide
  MOD_RES (16)..(16): hArg
  c-term amidation

SEQ ID NO: 2967 - protein, 35 aa, Artificial Sequence; identical to SEQ ID NO: 2831
  Description of Artificial Sequence: Synthetic peptide
  MOD_RES (16)..(16): Cit
  c-term amidation

SEQ ID NO: 2968 - protein, 35 aa, Artificial Sequence; identical to SEQ ID NO: 2831
  Description of Artificial Sequence: Synthetic peptide
  MOD_RES (16)..(16): hCit
  c-term amidation

SEQ ID NO: 2969 - protein, 35 aa, Artificial Sequence; identical to SEQ ID NO: 2831
  Description of Artificial Sequence: Synthetic peptide
  MOD_RES (16)..(16): Dpr
  c-term amidation

SEQ ID NO: 2970 - protein, 33 aa, Artificial Sequence
  Description of Artificial Sequence: Synthetic peptide
  MOD_RES (16)..(16): Orn
  c-term amidation
GVIINVKCKISAQCLXPCKEAGMRFGKCANGKC

SEQ ID NO: 2971 - protein, 33 aa, Artificial Sequence; identical to SEQ ID NO: 2970
  Description of Artificial Sequence: Synthetic peptide
  MOD_RES (16)..(16): hLys
  c-term amidation

SEQ ID NO: 2972 - protein, 33 aa, Artificial Sequence; identical to SEQ ID NO: 2970
  Description of Artificial Sequence: Synthetic peptide
  MOD_RES (16)..(16): hArg
  c-term amidation

SEQ ID NO: 2973 - protein, 33 aa, Artificial Sequence; identical to SEQ ID NO: 2970
  Description of Artificial Sequence: Synthetic peptide
  MOD_RES (16)..(16): Cit
  c-term amidation

SEQ ID NO: 2974 - protein, 35 aa, Artificial Sequence; identical to SEQ ID NO: 2831
  Description of Artificial Sequence: Synthetic peptide
  MOD_RES (16)..(16): hCit
  c-term amidation

SEQ ID NO: 2975 - protein, 33 aa, Artificial Sequence; identical to SEQ ID NO: 2970
  Description of Artificial Sequence: Synthetic peptide
  MOD_RES (16)..(16): Dpr
  c-term amidation

SEQ ID NO: 2976 - protein, 33 aa, Artificial Sequence; identical to SEQ ID NO: 2970
  Description of Artificial Sequence: Synthetic peptide
  MOD_RES (16)..(16): Dab
  c-term amidation

SEQ ID NO: 2977 - protein, 38 aa, Artificial Sequence
  Description of Artificial Sequence: Synthetic peptide
  c-term amidation
GVIINVKCKISAQCLKPCKEAGMRFGKCANGKCHCWGG

SEQ ID NO: 2978 - protein, 38 aa, Artificial Sequence; identical to SEQ ID NO: 2845
  Description of Artificial Sequence: Synthetic peptide
  MOD_RES (16)..(16): Orn
  c-term amidation

SEQ ID NO: 2979 - protein, 38 aa, Artificial Sequence; identical to SEQ ID NO: 2845
  Description of Artificial Sequence: Synthetic peptide
  MOD_RES (16)..(16): hLys
  c-term amidation

SEQ ID NO: 2980 - protein, 38 aa, Artificial Sequence; identical to SEQ ID NO: 2845
  Description of Artificial Sequence: Synthetic peptide
  MOD_RES (16)..(16): hArg
  c-term amidation

SEQ ID NO: 2981 - protein, 38 aa, Artificial Sequence; identical to SEQ ID NO: 2845
  Description of Artificial Sequence: Synthetic peptide
  MOD_RES (16)..(16): Cit
  c-term amidation

SEQ ID NO: 2982 - protein, 38 aa, Artificial Sequence; identical to SEQ ID NO: 2845
  Description of Artificial Sequence: Synthetic peptide
  MOD_RES (16)..(16): hCit
  c-term amidation

SEQ ID NO: 2983 - protein, 38 aa, Artificial Sequence; identical to SEQ ID NO: 2845
  Description of Artificial Sequence: Synthetic peptide
  MOD_RES (16)..(16): Dpr
  c-term amidation

SEQ ID NO: 2984 - protein, 38 aa, Artificial Sequence; identical to SEQ ID NO: 2845
  Description of Artificial Sequence: Synthetic peptide
  MOD_RES (16)..(16): Dab
  c-term amidation

SEQ ID NO: 2985 - protein, 38 aa, Artificial Sequence
  Description of Artificial Sequence: Synthetic peptide
  c-term amidation
GVIINVKCKISAQCLKPCKEAGMRFGKCANGKCACYGG

SEQ ID NO: 2986 - protein, 38 aa, Artificial Sequence; identical to SEQ ID NO: 2855
  Description of Artificial Sequence: Synthetic peptide
  MOD_RES (16)..(16): Orn
  c-term amidation

SEQ ID NO: 2987 - protein, 38 aa, Artificial Sequence; identical to SEQ ID NO: 2855
  Description of Artificial Sequence: Synthetic peptide
  MOD_RES (16)..(16): hLys
  c-term amidation

SEQ ID NO: 2988 - protein, 38 aa, Artificial Sequence; identical to SEQ ID NO: 2855
  Description of Artificial Sequence: Synthetic peptide
  MOD_RES (16)..(16): hArg
  c-term amidation

SEQ ID NO: 2989 - protein, 38 aa, Artificial Sequence; identical to SEQ ID NO: 2855
  Description of Artificial Sequence: Synthetic peptide
  MOD_RES (16)..(16): Cit
  c-term amidation

SEQ ID NO: 2990 - protein, 38 aa, Artificial Sequence; identical to SEQ ID NO: 2845
  Description of Artificial Sequence: Synthetic peptide
  MOD_RES (16)..(16): hCit
  c-term amidation

SEQ ID NO: 2991 - protein, 38 aa, Artificial Sequence; identical to SEQ ID NO: 2855
  Description of Artificial Sequence: Synthetic peptide
  MOD_RES (16)..(16): Dpr
  c-term amidation

SEQ ID NO: 2992 - protein, 38 aa, Artificial Sequence; identical to SEQ ID NO: 2855
  Description of Artificial Sequence: Synthetic peptide
  MOD_RES (16)..(16): Dab
  c-term amidation

SEQ ID NO: 2993 - protein, 38 aa, Artificial Sequence; identical to SEQ ID NO: 2863
  Description of Artificial Sequence: Synthetic peptide
  MOD_RES (16)..(16): Orn
  c-term amidation

SEQ ID NO: 2994 - protein, 38 aa, Artificial Sequence; identical to SEQ ID NO: 2863
  Description of Artificial Sequence: Synthetic peptide
  MOD_RES (16)..(16): hLys
  c-term amidation

SEQ ID NO: 2995 - protein, 38 aa, Artificial Sequence; identical to SEQ ID NO: 2863
  Description of Artificial Sequence: Synthetic peptide
  MOD_RES (16)..(16): hArg
  c-term amidation

SEQ ID NO: 2996 - protein, 38 aa, Artificial Sequence; identical to SEQ ID NO: 2863
  Description of Artificial Sequence: Synthetic peptide
  MOD_RES (16)..(16): Cit
  c-term amidation

SEQ ID NO: 2997 - protein, 38 aa, Artificial Sequence; identical to SEQ ID NO: 2863
  Description of Artificial Sequence: Synthetic peptide
  MOD_RES (16)..(16): hCit
  c-term amidation

SEQ ID NO: 2998 - protein, 38 aa, Artificial Sequence; identical to SEQ ID NO: 2863
  Description of Artificial Sequence: Synthetic peptide
  MOD_RES (16)..(16): Dpr
  c-term amidation

SEQ ID NO: 2999 - protein, 38 aa, Artificial Sequence; identical to SEQ ID NO: 2869
  Description of Artificial Sequence: Synthetic peptide
  MOD_RES (16)..(16): Orn
  c-term amidation

SEQ ID NO: 3000 - protein, 38 aa, Artificial Sequence; identical to SEQ ID NO: 2869
  Description of Artificial Sequence: Synthetic peptide
  MOD_RES (16)..(16): hLys
  c-term amidation

SEQ ID NO: 3001 - protein, 38 aa, Artificial Sequence; identical to SEQ ID NO: 2869
  Description of Artificial Sequence: Synthetic peptide
  MOD_RES (16)..(16): hArg
  c-term amidation

SEQ ID NO: 3002 - protein, 38 aa, Artificial Sequence; identical to SEQ ID NO: 2869
  Description of Artificial Sequence: Synthetic peptide
  MOD_RES (16)..(16): Cit
  c-term amidation

SEQ ID NO: 3003 - protein, 37 aa, Artificial Sequence; identical to SEQ ID NO: 2873
  Description of Artificial Sequence: Synthetic peptide
  MOD_RES (16)..(16): hCit
  c-term amidation

SEQ ID NO: 3004 - protein, 38 aa, Artificial Sequence; identical to SEQ ID NO: 2869
  Description of Artificial Sequence: Synthetic peptide
  MOD_RES (16)..(16): Dpr
  c-term amidation

SEQ ID NO: 3005 - protein, 38 aa, Artificial Sequence; identical to SEQ ID NO: 2869
  Description of Artificial Sequence: Synthetic peptide
  MOD_RES (16)..(16): Dab
  c-term amidation

SEQ ID NO: 3006 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCANGKCACYGG

SEQ ID NO: 3007 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCANGKCACGGG

SEQ ID NO: 3008 - protein, 36 aa, Artificial Sequence
  Description of Artificial Sequence: Synthetic peptide
  MOD_RES (20)..(20): Cpa
  c-term amidation
GVIINVKCKISAQCLKPCKXAGMRFGKCANGKCACY

SEQ ID NO: 3009 - protein, 38 aa, Artificial Sequence; identical to SEQ ID NO: 2785
  Description of Artificial Sequence: Synthetic peptide
  n-term acetylation
  c-term amidation

SEQ ID NO: 3010 - protein, 38 aa, Artificial Sequence; identical to SEQ ID NO: 3006
  Description of Artificial Sequence: Synthetic peptide
  MOD_RES (20)..(20): Aad
  c-term amidation

SEQ ID NO: 3011 - protein, 38 aa, Artificial Sequence
  Description of Artificial Sequence: Synthetic peptide
  MOD_RES (20)..(20): Aad
  c-term amidation
GVIINVKCKISAQCLKPCKXAGMRFGKCANGKCHCYGG

SEQ ID NO: 3012 - protein, 38 aa, Artificial Sequence; identical to SEQ ID NO: 3006
  Description of Artificial Sequence: Synthetic peptide
  MOD_RES (20)..(20): Aad

SEQ ID NO: 3013 - protein, 38 aa, Artificial Sequence
  Description of Artificial Sequence: Synthetic peptide
  c-term amidation
GVIINVKCKISAQCLHPCKDAGMRFGKCANGKCACYGG

SEQ ID NO: 3014 - protein, 38 aa, Artificial Sequence; identical to SEQ ID NO: 3013
  Description of Artificial Sequence: Synthetic peptide

SEQ ID NO: 3015 - protein, 36 aa, Artificial Sequence
  Description of Artificial Sequence: Synthetic peptide
  c-term amidation
GVIINVKCKISAQCLHPCKDAGMRFGKCANGKCACY

SEQ ID NO: 3016 - protein, 38 aa, Artificial Sequence
  Description of Artificial Sequence: Synthetic peptide
  c-term amidation
GVIINVKCKISAQCLHPCKDAGMRFGKCANGKCHCYGG

SEQ ID NO: 3017 - protein, 38 aa, Artificial Sequence; identical to SEQ ID NO: 3016
  Description of Artificial Sequence: Synthetic peptide

SEQ ID NO: 3018 - protein, 38 aa, Artificial Sequence
  Description of Artificial Sequence: Synthetic peptide
GVIINVKCKISAQCLHPCKDAGMRFGKCANGKCHCYPK

SEQ ID NO: 3019 - protein, 35 aa, Artificial Sequence
  Description of Artificial Sequence: Synthetic peptide
GVIINVKCKISAQCLHPCKDAGMRFGKCANGKCAC

SEQ ID NO: 3020 - protein, 38 aa, Artificial Sequence
  Description of Artificial Sequence: Synthetic peptide
  MOD_RES (36)..(36): 1Nal
  c-term amidation
GVIINVKCKISAQCLKPCKDAGMRFGKCANGKCACXGG

SEQ ID NO: 3021 - protein, 38 aa, Artificial Sequence
  Description of Artificial Sequence: Synthetic peptide
  MOD_RES (36)..(36): 1Nal
  c-term amidation
GVIINVKCKISAQCLKPCKDAGMRFGKCANGKCACXPK

SEQ ID NO: 3022 - protein, 38 aa, Artificial Sequence; identical to SEQ ID NO: 3020
  Description of Artificial Sequence: Synthetic peptide
  MOD_RES (36)..(36): 2Nal
  c-term amidation

SEQ ID NO: 3023 - protein, 38 aa, Artificial Sequence; identical to SEQ ID NO: 3020
  Description of Artificial Sequence: Synthetic peptide
  MOD_RES (36)..(36): Cha
  c-term amidation

SEQ ID NO: 3024 - protein, 38 aa, Artificial Sequence; identical to SEQ ID NO: 3020
  Description of Artificial Sequence: Synthetic peptide
  MOD_RES (36)..(36): MePhe
  c-term amidation

SEQ ID NO: 3025 - protein, 38 aa, Artificial Sequence; identical to SEQ ID NO: 3020
  Description of Artificial Sequence: Synthetic peptide
  MOD_RES (36)..(36): BiPhA
  c-term amidation

SEQ ID NO: 3026 - protein, 38 aa, Artificial Sequence
  Description of Artificial Sequence: Synthetic peptide
  MOD_RES (34)..(34): Aib
  c-term amidation
GVIINVKCKISAQCLKPCKDAGMRFGKCANGKCXCYGG

SEQ ID NO: 3027 - protein, 38 aa, Artificial Sequence; identical to SEQ ID NO: 3026
  Description of Artificial Sequence: Synthetic peptide
  MOD_RES (34)..(34): Abu
  c-term amidation

SEQ ID NO: 3028 - protein, 36 aa, Artificial Sequence
  Description of Artificial Sequence: Synthetic peptide
  MOD_RES (36)..(36): 1Nal
GVIINVKCKISAQCLKPCKDAGMRFGKCANGKCACX

SEQ ID NO: 3029 - protein, 38 aa, Artificial Sequence
  Description of Artificial Sequence: Synthetic peptide
  MOD_RES (36)..(36): 1Nal
  c-term amidation
GVIINVKCKISAQCLHPCKDAGMRFGKCANGKCACXGG

SEQ ID NO: 3030 - protein, 36 aa, Artificial Sequence; identical to SEQ ID NO: 3028
  Description of Artificial Sequence: Synthetic peptide
  MOD_RES (36)..(36): 4Bip
  c-term amidation

SEQ ID NO: 3031 - protein, 38 aa, Artificial Sequence; identical to SEQ ID NO: 3029
  Description of Artificial Sequence: Synthetic peptide
  MOD_RES (36)..(36): 4Bip
  c-term amidation

SEQ ID NO: 3032 - protein, 38 aa, Artificial Sequence
  Description of Artificial Sequence: Synthetic peptide
GVIINVKCKISAQCLKPCKDAGMRFGKCANGKCHCGGG

SEQ ID NO: 3033 - protein, 38 aa, Artificial Sequence
  Description of Artificial Sequence: Synthetic peptide
GVIINVKCKISAQCLEPCKKAGMRFGKCMAGKCHCTPK

SEQ ID NO: 3034 - protein, 38 aa, Artificial Sequence
  Description of Artificial Sequence: Synthetic peptide
GVIINVSCKISAQCLEPCKKAGMRFGKCMAGKCHCTPK

SEQ ID NO: 3035 - protein, 38 aa, Artificial Sequence
  Description of Artificial Sequence: Synthetic peptide
GVIINVKCKISAQCLKPCKKAGMRFGKCMAGKCHCTPK

SEQ ID NO: 3036 - protein, 38 aa, Artificial Sequence
  Description of Artificial Sequence: Synthetic peptide
GVIINVKCKISAQCLEPCKDAGMRFGKCMAGKCHCTPK

SEQ ID NO: 3037 - protein, 38 aa, Artificial Sequence
  Description of Artificial Sequence: Synthetic peptide
GVIINVKCKISAQCLKPCKDAGMRFGKCMAGKCHCTPK

SEQ ID NO: 3038 - protein, 38 aa, Artificial Sequence
  Description of Artificial Sequence: Synthetic peptide
GVIINVSCKISAQCLKPCKDAGMRFGKCMAGKCHCTPK

SEQ ID NO: 3039 - protein, 38 aa, Artificial Sequence
  Description of Artificial Sequence: Synthetic peptide
GVIINVKCKISPQCLKPCKDAGMRFGKCMAGKCHCTPK

SEQ ID NO: 3040 - protein, 38 aa, Artificial Sequence
  Description of Artificial Sequence: Synthetic peptide
GVIINVKCKISAQCLKPCKDAGMRFGKCMAGKCHCYPK

SEQ ID NO: 3041 - protein, 38 aa, Artificial Sequence; identical to SEQ ID NO: 3039
  Description of Artificial Sequence: Synthetic peptide
  n-term acetylation

SEQ ID NO: 3042 - protein, 38 aa, Artificial Sequence; identical to SEQ ID NO: 3039
  Description of Artificial Sequence: Synthetic peptide
  c-term amidation

SEQ ID NO: 3043 - protein, 38 aa, Artificial Sequence; identical to SEQ ID NO: 3039
  Description of Artificial Sequence: Synthetic peptide
  n-term acetylation
  c-term amidation

SEQ ID NO: 3044 - protein, 38 aa, Artificial Sequence; identical to SEQ ID NO: 3040
  Description of Artificial Sequence: Synthetic peptide
  c-term amidation

SEQ ID NO: 3045 - protein, 38 aa, Artificial Sequence; identical to SEQ ID NO: 3040
  Description of Artificial Sequence: Synthetic peptide
  n-term acetylation

SEQ ID NO: 3046 - protein, 38 aa, Artificial Sequence; identical to SEQ ID NO: 3040
  Description of Artificial Sequence: Synthetic peptide
  n-term acetylation
  c-term amidation

SEQ ID NO: 3047 - protein, 38 aa, Artificial Sequence; identical to SEQ ID NO: 3035
  Description of Artificial Sequence: Synthetic peptide
  c-term amidation

SEQ ID NO: 3048 - protein, 38 aa, Artificial Sequence; identical to SEQ ID NO: 3035
  Description of Artificial Sequence: Synthetic peptide
  n-term acetylation

SEQ ID NO: 3049 - protein, 38 aa, Artificial Sequence; identical to SEQ ID NO: 3035
  Description of Artificial Sequence: Synthetic peptide
  n-term acetylation
  c-term amidation

SEQ ID NO: 3050 - protein, 38 aa, Artificial Sequence; identical to SEQ ID NO: 3036
  Description of Artificial Sequence: Synthetic peptide
  n-term acetylation

SEQ ID NO: 3051 - protein, 38 aa, Artificial Sequence; identical to SEQ ID NO: 3036
  Description of Artificial Sequence: Synthetic peptide
  c-term amidation

SEQ ID NO: 3052 - protein, 38 aa, Artificial Sequence; identical to SEQ ID NO: 3036
  Description of Artificial Sequence: Synthetic peptide
  n-term acetylation
  c-term amidation

SEQ ID NO: 3053 - protein, 38 aa, Artificial Sequence; identical to SEQ ID NO: 3033
  Description of Artificial Sequence: Synthetic peptide
  c-term amidation

SEQ ID NO: 3054 - protein, 38 aa, Artificial Sequence; identical to SEQ ID NO: 3033
  Description of Artificial Sequence: Synthetic peptide
  n-term acetylation

SEQ ID NO: 3055 - protein, 38 aa, Artificial Sequence; identical to SEQ ID NO: 3033
  Description of Artificial Sequence: Synthetic peptide
  n-term acetylation
  c-term amidation

SEQ ID NO: 3056 - protein, 38 aa, Artificial Sequence; identical to SEQ ID NO: 3037
  Description of Artificial Sequence: Synthetic peptide
  c-term amidation

SEQ ID NO: 3057 - protein, 38 aa, Artificial Sequence; identical to SEQ ID NO: 3037
  Description of Artificial Sequence: Synthetic peptide
  n-term acetylation

SEQ ID NO: 3058 - protein, 38 aa, Artificial Sequence; identical to SEQ ID NO: 3037
  Description of Artificial Sequence: Synthetic peptide
  n-term acetylation
  c-term amidation

SEQ ID NO: 3059 - protein, 37 aa, Artificial Sequence
  Description of Artificial Sequence: Synthetic peptide
VIINVKCKISAQCLEPCKKAGMRFGKCMAGKCHCTPK

SEQ ID NO: 3060 - protein, 37 aa, Artificial Sequence; identical to SEQ ID NO: 3059
  Description of Artificial Sequence: Synthetic peptide
  n-term acetylation

SEQ ID NO: 3061 - protein, 37 aa, Artificial Sequence; identical to SEQ ID NO: 3059
  Description of Artificial Sequence: Synthetic peptide
  c-term amidation

SEQ ID NO: 3062 - protein, 37 aa, Artificial Sequence; identical to SEQ ID NO: 3059
  Description of Artificial Sequence: Synthetic peptide
  n-term acetylation
  c-term amidation

SEQ ID NO: 3063 - protein, 38 aa, Artificial Sequence
  Description of Artificial Sequence: Synthetic peptide
GVIINVKCKISAQCLEPCKKAGMRFGKCMAGKCACTPK

SEQ ID NO: 3064 - protein, 38 aa, Artificial Sequence; identical to SEQ ID NO: 3063
  Description of Artificial Sequence: Synthetic peptide
  n-term acetylation

SEQ ID NO: 3065 - protein, 38 aa, Artificial Sequence; identical to SEQ ID NO: 3063
  Description of Artificial Sequence: Synthetic peptide
  c-term amidation

SEQ ID NO: 3066 - protein, 38 aa, Artificial Sequence; identical to SEQ ID NO: 3063
  Description of Artificial Sequence: Synthetic peptide
  n-term acetylation
  c-term amidation

SEQ ID NO: 3067 - protein, 37 aa, Artificial Sequence
  Description of Artificial Sequence: Synthetic peptide
VIINVKCKISAQCLKPCKDAGMRFGKCMAGKCHCTPK

SEQ ID NO: 3068 - protein, 37 aa, Artificial Sequence; identical to SEQ ID NO: 3067
  Description of Artificial Sequence: Synthetic peptide
  n-term acetylation

SEQ ID NO: 3069 - protein, 37 aa, Artificial Sequence; identical to SEQ ID NO: 3067
  Description of Artificial Sequence: Synthetic peptide
  c-term amidation

SEQ ID NO: 3070 - protein, 37 aa, Artificial Sequence; identical to SEQ ID NO: 3067
  Description of Artificial Sequence: Synthetic peptide
  n-term acetylation
  c-term amidation

SEQ ID NO: 3071 - protein, 34 aa, Artificial Sequence
  Description of Artificial Sequence: Synthetic peptide
NVKCKISAQCLKPCKDAGMRFGKCMAGKCHCTPK

SEQ ID NO: 3072 - protein, 34 aa, Artificial Sequence; identical to SEQ ID NO: 3071
  Description of Artificial Sequence: Synthetic peptide
  n-term acetylation

SEQ ID NO: 3073 - protein, 34 aa, Artificial Sequence; identical to SEQ ID NO: 3071
  Description of Artificial Sequence: Synthetic peptide
  c-term amidation

SEQ ID NO: 3074 - protein, 34 aa, Artificial Sequence; identical to SEQ ID NO: 3071
  Description of Artificial Sequence: Synthetic peptide
  n-term acetylation
  c-term amidation

SEQ ID NO: 3075 - protein, 32 aa, Artificial Sequence
  Description of Artificial Sequence: Synthetic peptide
KCKISAQCLKPCKDAGMRFGKCMAGKCHCTPK

SEQ ID NO: 3076 - protein, 32 aa, Artificial Sequence; identical to SEQ ID NO: 3075
  Description of Artificial Sequence: Synthetic peptide
  n-term acetylation

SEQ ID NO: 3077 - protein, 32 aa, Artificial Sequence; identical to SEQ ID NO: 3075
  Description of Artificial Sequence: Synthetic peptide
  c-term amidation

SEQ ID NO: 3078 - protein, 32 aa, Artificial Sequence; identical to SEQ ID NO: 3075
  Description of Artificial Sequence: Synthetic peptide
  n-term acetylation
  c-term amidation

SEQ ID NO: 3079 - protein, 31 aa, Artificial Sequence
  Description of Artificial Sequence: Synthetic peptide
CKISAQCLKPCKDAGMRFGKCMAGKCHCTPK

SEQ ID NO: 3080 - protein, 31 aa, Artificial Sequence; identical to SEQ ID NO: 3079
  Description of Artificial Sequence: Synthetic peptide
  n-term acetylation

SEQ ID NO: 3081 - protein, 31 aa, Artificial Sequence; identical to SEQ ID NO: 3079
  Description of Artificial Sequence: Synthetic peptide
  c-term amidation

SEQ ID NO: 3082 - protein, 31 aa, Artificial Sequence; identical to SEQ ID NO: 3079
  Description of Artificial Sequence: Synthetic peptide
  n-term acetylation
  c-term amidation

SEQ ID NO: 3083 - protein, 38 aa, Artificial Sequence
  Description of Artificial Sequence: Synthetic peptide
GVIINVKCKISAQCLKPCKDAGMRNGKCMAGKCHCTPK

SEQ ID NO: 3084 - protein, 38 aa, Artificial Sequence; identical to SEQ ID NO: 3083
  Description of Artificial Sequence: Synthetic peptide
  c-term amidation

SEQ ID NO: 3085 - protein, 38 aa, Artificial Sequence; identical to SEQ ID NO: 3083
  Description of Artificial Sequence: Synthetic peptide
  n-term acetylation

SEQ ID NO: 3086 - protein, 38 aa, Artificial Sequence; identical to SEQ ID NO: 3083
  Description of Artificial Sequence: Synthetic peptide
  n-term acetylation
  c-term amidation

SEQ ID NO: 3087 - protein, 38 aa, Artificial Sequence; identical to SEQ ID NO: 1952
  Description of Artificial Sequence: Synthetic peptide

SEQ ID NO: 3088 - protein, 38 aa, Artificial Sequence; identical to SEQ ID NO: 1952
  Description of Artificial Sequence: Synthetic peptide
  c-term amidation

SEQ ID NO: 3089 - protein, 38 aa, Artificial Sequence; identical to SEQ ID NO: 1952
  Description of Artificial Sequence: Synthetic peptide
  n-term acetylation

SEQ ID NO: 3090 - protein, 38 aa, Artificial Sequence; identical to SEQ ID NO: 1952
  Description of Artificial Sequence: Synthetic peptide
  n-term acetylation
  c-term amidation

SEQ ID NO: 3091 - protein, 38 aa, Artificial Sequence
  Description of Artificial Sequence: Synthetic peptide
GVIINVKCKISKQCLKPCRDAGMRFGKCMAGKCHCTPK

SEQ ID NO: 3092 - protein, 38 aa, Artificial Sequence; identical to SEQ ID NO: 3091
  Description of Artificial Sequence: Synthetic peptide
  n-term acetylation

SEQ ID NO: 3093 - protein, 38 aa, Artificial Sequence; identical to SEQ ID NO: 3091
  Description of Artificial Sequence: Synthetic peptide
  c-term amidation

SEQ ID NO: 3094 - protein, 38 aa, Artificial Sequence; identical to SEQ ID NO: 3091
  Description of Artificial Sequence: Synthetic peptide
  n-term acetylation
  c-term amidation

SEQ ID NO: 3095 - protein, 37 aa, Artificial Sequence
  Description of Artificial Sequence: Synthetic peptide
TIINVKCKISAQCLKPCKDAGMRFGKCMAGKCHCTPK

SEQ ID NO: 3096 - protein, 37 aa, Artificial Sequence; identical to SEQ ID NO: 3095
  Description of Artificial Sequence: Synthetic peptide
  n-term acetylation

SEQ ID NO: 3097 - protein, 37 aa, Artificial Sequence; identical to SEQ ID NO: 3095
  Description of Artificial Sequence: Synthetic peptide
  c-term amidation

SEQ ID NO: 3098 - protein, 37 aa, Artificial Sequence; identical to SEQ ID NO: 3095
  Description of Artificial Sequence: Synthetic peptide
  n-term acetylation
  c-term amidation

SEQ ID NO: 3099 - protein, 38 aa, Artificial Sequence
  Description of Artificial Sequence: Synthetic peptide
GVKINVKCKISAQCLEPCKKAGMRFGKCMAGKCHCTPK

SEQ ID NO: 3100 - protein, 38 aa, Artificial Sequence; identical to SEQ ID NO: 3099
  Description of Artificial Sequence: Synthetic peptide
  n-term acetylation

SEQ ID NO: 3101 - protein, 38 aa, Artificial Sequence; identical to SEQ ID NO: 3099
  Description of Artificial Sequence: Synthetic peptide
  c-term amidation

SEQ ID NO: 3102 - protein, 38 aa, Artificial Sequence; identical to SEQ ID NO: 3099
  Description of Artificial Sequence: Synthetic peptide
  n-term acetylation
  c-term amidation

SEQ ID NO: 3103 - protein, 38 aa, Artificial Sequence
  Description of Artificial Sequence: Synthetic peptide
GVKINVKCKISAQCLEPCKKAGMRFGKCMAGKCACTPK

SEQ ID NO: 3104 - protein, 38 aa, Artificial Sequence
  Description of Artificial Sequence: Synthetic peptide
GVKINVKCKISAQCLKPCKDAGMRFGKCMAGKCHCTPK

SEQ ID NO: 3105 - protein, 38 aa, Artificial Sequence
  Description of Artificial Sequence: Synthetic peptide
GVKINVKCKISAQCLKPCKDAGMRFGKCMAGKCACTPK

SEQ ID NO: 3106 - protein, 38 aa, Artificial Sequence; identical to SEQ ID NO: 3103
  Description of Artificial Sequence: Synthetic peptide
  n-term acetylation

SEQ ID NO: 3107 - protein, 38 aa, Artificial Sequence; identical to SEQ ID NO: 3103
  Description of Artificial Sequence: Synthetic peptide
  c-term amidation

SEQ ID NO: 3108 - protein, 38 aa, Artificial Sequence; identical to SEQ ID NO: 3103
  Description of Artificial Sequence: Synthetic peptide
  n-term acetylation
  c-term amidation

SEQ ID NO: 3109 - protein, 38 aa, Artificial Sequence; identical to SEQ ID NO: 3105
  Description of Artificial Sequence: Synthetic peptide
  n-term acetylation

SEQ ID NO: 3110 - protein, 38 aa, Artificial Sequence; identical to SEQ ID NO: 3105
  Description of Artificial Sequence: Synthetic peptide
  c-term amidation

SEQ ID NO: 3111 - protein, 38 aa, Artificial Sequence; identical to SEQ ID NO: 3105
  Description of Artificial Sequence: Synthetic peptide
  n-term acetylation
  c-term amidation

SEQ ID NO: 3112 - protein, 38 aa, Artificial Sequence; identical to SEQ ID NO: 3104
  Description of Artificial Sequence: Synthetic peptide
  n-term acetylation

SEQ ID NO: 3113 - protein, 38 aa, Artificial Sequence; identical to SEQ ID NO: 3104
  Description of Artificial Sequence: Synthetic peptide
  c-term amidation

SEQ ID NO: 3114 - protein, 38 aa, Artificial Sequence; identical to SEQ ID NO: 3104
  Description of Artificial Sequence: Synthetic peptide
  n-term acetylation
  c-term amidation

SEQ ID NO: 3115 - protein, 36 aa, Artificial Sequence
  Description of Artificial Sequence: Synthetic peptide
GVIINVKCKISAQCLKPCKDAGMRFGKCMAGKCHCT

SEQ ID NO: 3116 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCHCTPK

SEQ ID NO: 3117 - protein, 38 aa, Artificial Sequence; identical to SEQ ID NO: 3116
  Description of Artificial Sequence: Synthetic peptide
  MOD_RES (16)..(16): hLys

SEQ ID NO: 3118 - protein, 38 aa, Artificial Sequence; identical to SEQ ID NO: 3116
  Description of Artificial Sequence: Synthetic peptide
  MOD_RES (16)..(16): hArg

SEQ ID NO: 3119 - protein, 38 aa, Artificial Sequence; identical to SEQ ID NO: 3116
  Description of Artificial Sequence: Synthetic peptide
  MOD_RES (16)..(16): Cit

SEQ ID NO: 3120 - protein, 38 aa, Artificial Sequence; identical to SEQ ID NO: 3116
  Description of Artificial Sequence: Synthetic peptide
  MOD_RES (16)..(16): hCit

SEQ ID NO: 3121 - protein, 38 aa, Artificial Sequence; identical to SEQ ID NO: 3116
  Description of Artificial Sequence: Synthetic peptide
  MOD_RES (16)..(16): Dpr

SEQ ID NO: 3122 - protein, 38 aa, Artificial Sequence; identical to SEQ ID NO: 3116
  Description of Artificial Sequence: Synthetic peptide
  MOD_RES (16)..(16): Dab

SEQ ID NO: 3123 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCHCYPK

SEQ ID NO: 3124 - protein, 38 aa, Artificial Sequence; identical to SEQ ID NO: 3123
  Description of Artificial Sequence: Synthetic peptide
  MOD_RES (16)..(16): hLys

SEQ ID NO: 3125 - protein, 38 aa, Artificial Sequence; identical to SEQ ID NO: 3123
  Description of Artificial Sequence: Synthetic peptide
  MOD_RES (16)..(16): hArg

SEQ ID NO: 3126 - protein, 38 aa, Artificial Sequence; identical to SEQ ID NO: 3123
  Description of Artificial Sequence: Synthetic peptide
  MOD_RES (16)..(16): Cit

SEQ ID NO: 3127 - protein, 38 aa, Artificial Sequence; identical to SEQ ID NO: 3123
  Description of Artificial Sequence: Synthetic peptide
  MOD_RES (16)..(16): hCit

SEQ ID NO: 3128 - protein, 38 aa, Artificial Sequence; identical to SEQ ID NO: 3123
  Description of Artificial Sequence: Synthetic peptide
  MOD_RES (16)..(16): Dpr

SEQ ID NO: 3129 - protein, 38 aa, Artificial Sequence; identical to SEQ ID NO: 3123
  Description of Artificial Sequence: Synthetic peptide
  MOD_RES (16)..(16): Dab

SEQ ID NO: 3130 - protein, 38 aa, Artificial Sequence
  Description of Artificial Sequence: Synthetic peptide
GVIINVKCKISAQCLKPCKDAGMRFGKCMAGKCACYPK

SEQ ID NO: 3131 - protein, 38 aa, Artificial Sequence
  Description of Artificial Sequence: Synthetic peptide
GVIINVKCKISAQCLKPCKDAGMRFGKCMAGKCGCYPK

SEQ ID NO: 3132 - protein, 38 aa, Artificial Sequence
  Description of Artificial Sequence: Synthetic peptide
GVIINVKCKISAQCLKPCKDAGMRFGKCMAGKCACFPK

SEQ ID NO: 3133 - protein, 35 aa, Artificial Sequence
  Description of Artificial Sequence: Synthetic peptide
  MOD_RES (16)..(16): hLys
GVIINVKCKISAQCLXPCKDAGMRFGKCMAGKCHC

SEQ ID NO: 3134 - protein, 35 aa, Artificial Sequence; identical to SEQ ID NO: 3133
  Description of Artificial Sequence: Synthetic peptide
  MOD_RES (16)..(16): hArg

SEQ ID NO: 3135 - protein, 35 aa, Artificial Sequence; identical to SEQ ID NO: 3133
  Description of Artificial Sequence: Synthetic peptide
  MOD_RES (16)..(16): Cit

SEQ ID NO: 3136 - protein, 35 aa, Artificial Sequence; identical to SEQ ID NO: 3133
  Description of Artificial Sequence: Synthetic peptide
  MOD_RES (16)..(16): hCit

SEQ ID NO: 3137 - protein, 35 aa, Artificial Sequence; identical to SEQ ID NO: 3133
  Description of Artificial Sequence: Synthetic peptide
  MOD_RES (16)..(16): Dpr

SEQ ID NO: 3138 - protein, 35 aa, Artificial Sequence; identical to SEQ ID NO: 3133
  Description of Artificial Sequence: Synthetic peptide
  MOD_RES (16)..(16): Dab

SEQ ID NO: 3139 - protein, 35 aa, Artificial Sequence
  Description of Artificial Sequence: Synthetic peptide
  MOD_RES (16)..(16): Orn
GVIINVKCKISAQCLXPCKDAGMRFGKCMAGKCAC

SEQ ID NO: 3140 - protein, 35 aa, Artificial Sequence; identical to SEQ ID NO: 3139
  Description of Artificial Sequence: Synthetic peptide
  MOD_RES (16)..(16): hLys

SEQ ID NO: 3141 - protein, 35 aa, Artificial Sequence; identical to SEQ ID NO: 3139
  Description of Artificial Sequence: Synthetic peptide
  MOD_RES (16)..(16): hArg

SEQ ID NO: 3142 - protein, 35 aa, Artificial Sequence; identical to SEQ ID NO: 3139
  Description of Artificial Sequence: Synthetic peptide
  MOD_RES (16)..(16): Cit

SEQ ID NO: 3143 - protein, 35 aa, Artificial Sequence; identical to SEQ ID NO: 3133
  Description of Artificial Sequence: Synthetic peptide
  MOD_RES (16)..(16): hCit

SEQ ID NO: 3144 - protein, 35 aa, Artificial Sequence; identical to SEQ ID NO: 3139
  Description of Artificial Sequence: Synthetic peptide
  MOD_RES (16)..(16): Dpr

SEQ ID NO: 3145 - protein, 35 aa, Artificial Sequence; identical to SEQ ID NO: 3139
  Description of Artificial Sequence: Synthetic peptide
  MOD_RES (16)..(16): Dab

SEQ ID NO: 3146 - protein, 38 aa, Artificial Sequence
  Description of Artificial Sequence: Synthetic peptide
GVIINVKCKISAQCLKPCKDAGMRFGKCMAGKCGCYGG

SEQ ID NO: 3147 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCHCYGG

SEQ ID NO: 3148 - protein, 38 aa, Artificial Sequence; identical to SEQ ID NO: 3147
  Description of Artificial Sequence: Synthetic peptide
  MOD_RES (16)..(16): hLys

SEQ ID NO: 3149 - protein, 38 aa, Artificial Sequence; identical to SEQ ID NO: 3147
  Description of Artificial Sequence: Synthetic peptide
  MOD_RES (16)..(16): hArg

SEQ ID NO: 3150 - protein, 38 aa, Artificial Sequence; identical to SEQ ID NO: 3147
  Description of Artificial Sequence: Synthetic peptide
  MOD_RES (16)..(16): Cit

SEQ ID NO: 3151 - protein, 38 aa, Artificial Sequence; identical to SEQ ID NO: 3147
  Description of Artificial Sequence: Synthetic peptide
  MOD_RES (16)..(16): hCit

SEQ ID NO: 3152 - protein, 38 aa, Artificial Sequence; identical to SEQ ID NO: 3147
  Description of Artificial Sequence: Synthetic peptide
  MOD_RES (16)..(16): Dpr

SEQ ID NO: 3153 - protein, 38 aa, Artificial Sequence
  Description of Artificial Sequence: Synthetic peptide
GVIINVKCKISAQCLKPCKDAGMRFGKCMAGKCACYGG

SEQ ID NO: 3154 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCACYGG

SEQ ID NO: 3155 - protein, 38 aa, Artificial Sequence; identical to SEQ ID NO: 3154
  Description of Artificial Sequence: Synthetic peptide
  MOD_RES (16)..(16): hLys

SEQ ID NO: 3156 - protein, 38 aa, Artificial Sequence; identical to SEQ ID NO: 3154
  Description of Artificial Sequence: Synthetic peptide
  MOD_RES (16)..(16): hArg

SEQ ID NO: 3157 - protein, 38 aa, Artificial Sequence; identical to SEQ ID NO: 3154
  Description of Artificial Sequence: Synthetic peptide
  MOD_RES (16)..(16): Cit

SEQ ID NO: 3158 - protein, 38 aa, Artificial Sequence; identical to SEQ ID NO: 3147
  Description of Artificial Sequence: Synthetic peptide
  MOD_RES (16)..(16): hCit

SEQ ID NO: 3159 - protein, 38 aa, Artificial Sequence; identical to SEQ ID NO: 3154
  Description of Artificial Sequence: Synthetic peptide
  MOD_RES (16)..(16): Dpr

SEQ ID NO: 3160 - protein, 38 aa, Artificial Sequence; identical to SEQ ID NO: 3154
  Description of Artificial Sequence: Synthetic peptide
  MOD_RES (16)..(16): Dab

SEQ ID NO: 3161 - protein, 37 aa, Artificial Sequence
  Description of Artificial Sequence: Synthetic peptide
GVIINVKCKISAQCLKPCKDAGMRFGKCMAGKCACYG

SEQ ID NO: 3162 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCHCGGG

SEQ ID NO: 3163 - protein, 38 aa, Artificial Sequence; identical to SEQ ID NO: 3162
  Description of Artificial Sequence: Synthetic peptide
  MOD_RES (16)..(16): hLys

SEQ ID NO: 3164 - protein, 38 aa, Artificial Sequence; identical to SEQ ID NO: 3162
  Description of Artificial Sequence: Synthetic peptide
  MOD_RES (16)..(16): hArg

SEQ ID NO: 3165 - protein, 38 aa, Artificial Sequence; identical to SEQ ID NO: 3162
  Description of Artificial Sequence: Synthetic peptide
  MOD_RES (16)..(16): Cit

SEQ ID NO: 3166 - protein, 38 aa, Artificial Sequence; identical to SEQ ID NO: 3162
  Description of Artificial Sequence: Synthetic peptide
  MOD_RES (16)..(16): hCit

SEQ ID NO: 3167 - protein, 38 aa, Artificial Sequence; identical to SEQ ID NO: 3162
  Description of Artificial Sequence: Synthetic peptide
  MOD_RES (16)..(16): Dpr

SEQ ID NO: 3168 - protein, 38 aa, Artificial Sequence
  Description of Artificial Sequence: Synthetic peptide
GVIINVKCKISAQCLKPCKDAGMRFGKCMAGKCACFGG

SEQ ID NO: 3169 - protein, 38 aa, Artificial Sequence
  Description of Artificial Sequence: Synthetic peptide
  MOD_RES (16)..(16): Orn
GVIINVKCKISAQCLXPCKDAGMRFGKCMAGKCACGGG

SEQ ID NO: 3170 - protein, 38 aa, Artificial Sequence; identical to SEQ ID NO: 3169
  Description of Artificial Sequence: Synthetic peptide
  MOD_RES (16)..(16): hLys

SEQ ID NO: 3171 - protein, 38 aa, Artificial Sequence; identical to SEQ ID NO: 3169
  Description of Artificial Sequence: Synthetic peptide
  MOD_RES (16)..(16): hArg

SEQ ID NO: 3172 - protein, 38 aa, Artificial Sequence; identical to SEQ ID NO: 3169
  Description of Artificial Sequence: Synthetic peptide
  MOD_RES (16)..(16): Cit

SEQ ID NO: 3173 - protein, 38 aa, Artificial Sequence; identical to SEQ ID NO: 3169
  Description of Artificial Sequence: Synthetic peptide
  MOD_RES (16)..(16): hCit

SEQ ID NO: 3174 - protein, 38 aa, Artificial Sequence; identical to SEQ ID NO: 3169
  Description of Artificial Sequence: Synthetic peptide
  MOD_RES (16)..(16): Dpr

SEQ ID NO: 3175 - protein, 38 aa, Artificial Sequence; identical to SEQ ID NO: 3169
  Description of Artificial Sequence: Synthetic peptide
  MOD_RES (16)..(16): Dab

SEQ ID NO: 3176 - protein, 37 aa, Artificial Sequence
  Description of Artificial Sequence: Synthetic peptide
GVIINVKCKISAQCLKPCKDAGMRFGKCMAGKCACGG

SEQ ID NO: 3177 - protein, 37 aa, Artificial Sequence; identical to SEQ ID NO: 3161
  Description of Artificial Sequence: Synthetic peptide

SEQ ID NO: 3178 - protein, 37 aa, Artificial Sequence
  Description of Artificial Sequence: Synthetic peptide
  MOD_RES (16)..(16): Orn
GVIINVKCKISAQCLXPCKDAGMRFGKCMAGKCACGG

SEQ ID NO: 3179 - protein, 38 aa, Artificial Sequence
  Description of Artificial Sequence: Synthetic peptide
  MOD_RES (16)..(16): hLys
GVIINVKCKISAQCLXPCKEAGMRFGKCMAGKCHCTPK

SEQ ID NO: 3180 - protein, 38 aa, Artificial Sequence; identical to SEQ ID NO: 3179
  Description of Artificial Sequence: Synthetic peptide
  MOD_RES (16)..(16): hArg

SEQ ID NO: 3181 - protein, 38 aa, Artificial Sequence; identical to SEQ ID NO: 3179
  Description of Artificial Sequence: Synthetic peptide
  MOD_RES (16)..(16): Cit

SEQ ID NO: 3182 - protein, 38 aa, Artificial Sequence; identical to SEQ ID NO: 3179
  Description of Artificial Sequence: Synthetic peptide
  MOD_RES (16)..(16): hCit

SEQ ID NO: 3183 - protein, 38 aa, Artificial Sequence; identical to SEQ ID NO: 3179
  Description of Artificial Sequence: Synthetic peptide
  MOD_RES (16)..(16): Dpr

SEQ ID NO: 3184 - protein, 38 aa, Artificial Sequence; identical to SEQ ID NO: 3179
  Description of Artificial Sequence: Synthetic peptide
  MOD_RES (16)..(16): Dab

SEQ ID NO: 3185 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCHCYPK

SEQ ID NO: 3186 - protein, 38 aa, Artificial Sequence; identical to SEQ ID NO: 3185
  Description of Artificial Sequence: Synthetic peptide
  MOD_RES (16)..(16): hLys

SEQ ID NO: 3187 - protein, 38 aa, Artificial Sequence; identical to SEQ ID NO: 3185
  Description of Artificial Sequence: Synthetic peptide
  MOD_RES (16)..(16): hArg

SEQ ID NO: 3188 - protein, 38 aa, Artificial Sequence; identical to SEQ ID NO: 3185
  Description of Artificial Sequence: Synthetic peptide
  MOD_RES (16)..(16): Cit

SEQ ID NO: 3189 - protein, 38 aa, Artificial Sequence; identical to SEQ ID NO: 3185
  Description of Artificial Sequence: Synthetic peptide
  MOD_RES (16)..(16): hCit

SEQ ID NO: 3190 - protein, 38 aa, Artificial Sequence; identical to SEQ ID NO: 3185
  Description of Artificial Sequence: Synthetic peptide
  MOD_RES (16)..(16): Dpr

SEQ ID NO: 3191 - protein, 38 aa, Artificial Sequence; identical to SEQ ID NO: 3185
  Description of Artificial Sequence: Synthetic peptide
  MOD_RES (16)..(16): Dab

SEQ ID NO: 3192 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCACTPK

SEQ ID NO: 3193 - protein, 38 aa, Artificial Sequence; identical to SEQ ID NO: 3192
  Description of Artificial Sequence: Synthetic peptide
  MOD_RES (16)..(16): hLys

SEQ ID NO: 3194 - protein, 38 aa, Artificial Sequence; identical to SEQ ID NO: 3192
  Description of Artificial Sequence: Synthetic peptide
  MOD_RES (16)..(16): hArg

SEQ ID NO: 3195 - protein, 38 aa, Artificial Sequence; identical to SEQ ID NO: 3192
  Description of Artificial Sequence: Synthetic peptide
  MOD_RES (16)..(16): Cit

SEQ ID NO: 3196 - protein, 38 aa, Artificial Sequence; identical to SEQ ID NO: 3179
  Description of Artificial Sequence: Synthetic peptide
  MOD_RES (16)..(16): hCit

SEQ ID NO: 3197 - protein, 38 aa, Artificial Sequence; identical to SEQ ID NO: 3192
  Description of Artificial Sequence: Synthetic peptide
  MOD_RES (16)..(16): Dpr

SEQ ID NO: 3198 - protein, 38 aa, Artificial Sequence; identical to SEQ ID NO: 3192
  Description of Artificial Sequence: Synthetic peptide
  MOD_RES (16)..(16): Dab

SEQ ID NO: 3199 - protein, 35 aa, Artificial Sequence
  Description of Artificial Sequence: Synthetic peptide
  MOD_RES (16)..(16): Orn
GVIINVKCKISAQCLXPCKEAGMRFGKCMAGKCHC

SEQ ID NO: 3200 - protein, 35 aa, Artificial Sequence; identical to SEQ ID NO: 3199
  Description of Artificial Sequence: Synthetic peptide
  MOD_RES (16)..(16): hLys

SEQ ID NO: 3201 - protein, 35 aa, Artificial Sequence; identical to SEQ ID NO: 3199
  Description of Artificial Sequence: Synthetic peptide
  MOD_RES (16)..(16): hArg

SEQ ID NO: 3202 - protein, 35 aa, Artificial Sequence; identical to SEQ ID NO: 3199
  Description of Artificial Sequence: Synthetic peptide
  MOD_RES (16)..(16): Cit

SEQ ID NO: 3203 - protein, 35 aa, Artificial Sequence; identical to SEQ ID NO: 3199
  Description of Artificial Sequence: Synthetic peptide
  MOD_RES (16)..(16): hCit

SEQ ID NO: 3204 - protein, 35 aa, Artificial Sequence; identical to SEQ ID NO: 3199
  Description of Artificial Sequence: Synthetic peptide
  MOD_RES (16)..(16): Dpr

SEQ ID NO: 3205 - protein, 35 aa, Artificial Sequence
  Description of Artificial Sequence: Synthetic peptide
  MOD_RES (16)..(16): Orn
GVIINVKCKISAQCLXPCKEAGMRFGKCMAGKCAC

SEQ ID NO: 3206 - protein, 35 aa, Artificial Sequence; identical to SEQ ID NO: 3205
  Description of Artificial Sequence: Synthetic peptide
  MOD_RES (16)..(16): hLys

SEQ ID NO: 3207 - protein, 35 aa, Artificial Sequence; identical to SEQ ID NO: 3205
  Description of Artificial Sequence: Synthetic peptide
  MOD_RES (16)..(16): hArg

SEQ ID NO: 3208 - protein, 35 aa, Artificial Sequence; identical to SEQ ID NO: 3205
  Description of Artificial Sequence: Synthetic peptide
  MOD_RES (16)..(16): Cit

SEQ ID NO: 3209 - protein, 35 aa, Artificial Sequence; identical to SEQ ID NO: 3199
  Description of Artificial Sequence: Synthetic peptide
  MOD_RES (16)..(16): hCit

SEQ ID NO: 3210 - protein, 35 aa, Artificial Sequence; identical to SEQ ID NO: 3205
  Description of Artificial Sequence: Synthetic peptide
  MOD_RES (16)..(16): Dpr

SEQ ID NO: 3211 - protein, 35 aa, Artificial Sequence; identical to SEQ ID NO: 3205
  Description of Artificial Sequence: Synthetic peptide
  MOD_RES (16)..(16): Dab

SEQ ID NO: 3212 - protein, 38 aa, Artificial Sequence
  Description of Artificial Sequence: Synthetic peptide
GVIINVKCKISAQCLKPCKEAGMRFGKCMAGKCHCYGG

SEQ ID NO: 3213 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCHCYGG

SEQ ID NO: 3214 - protein, 37 aa, Artificial Sequence
  Description of Artificial Sequence: Synthetic peptide
GVIINVKCKISAQCLKPCKEAGMRFGKCMAGKCHCYG

SEQ ID NO: 3215 - protein, 37 aa, Artificial Sequence
  Description of Artificial Sequence: Synthetic peptide
GVIINVKCKISAQCLKPCKEAGMRFGKCMAGKCACYG

SEQ ID NO: 3216 - protein, 38 aa, Artificial Sequence; identical to SEQ ID NO: 3213
  Description of Artificial Sequence: Synthetic peptide
  MOD_RES (16)..(16): hLys

SEQ ID NO: 3217 - protein, 38 aa, Artificial Sequence; identical to SEQ ID NO: 3213
  Description of Artificial Sequence: Synthetic peptide
  MOD_RES (16)..(16): hArg

SEQ ID NO: 3218 - protein, 38 aa, Artificial Sequence; identical to SEQ ID NO: 3213
  Description of Artificial Sequence: Synthetic peptide
  MOD_RES (16)..(16): Cit

SEQ ID NO: 3219 - protein, 38 aa, Artificial Sequence; identical to SEQ ID NO: 3213
  Description of Artificial Sequence: Synthetic peptide
  MOD_RES (16)..(16): hCit

SEQ ID NO: 3220 - protein, 38 aa, Artificial Sequence; identical to SEQ ID NO: 3213
  Description of Artificial Sequence: Synthetic peptide
  MOD_RES (16)..(16): Dpr

SEQ ID NO: 3221 - protein, 38 aa, Artificial Sequence; identical to SEQ ID NO: 3213
  Description of Artificial Sequence: Synthetic peptide
  MOD_RES (16)..(16): Dab

SEQ ID NO: 3222 - protein, 37 aa, Artificial Sequence; identical to SEQ ID NO: 3215
  Description of Artificial Sequence: Synthetic peptide

SEQ ID NO: 3223 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCACYGG

SEQ ID NO: 3224 - protein, 38 aa, Artificial Sequence; identical to SEQ ID NO: 3223
  Description of Artificial Sequence: Synthetic peptide
  MOD_RES (16)..(16): hLys

SEQ ID NO: 3225 - protein, 38 aa, Artificial Sequence; identical to SEQ ID NO: 3223
  Description of Artificial Sequence: Synthetic peptide
  MOD_RES (16)..(16): hArg

SEQ ID NO: 3226 - protein, 38 aa, Artificial Sequence; identical to SEQ ID NO: 3223
  Description of Artificial Sequence: Synthetic peptide
  MOD_RES (16)..(16): Cit

SEQ ID NO: 3227 - protein, 38 aa, Artificial Sequence; identical to SEQ ID NO: 3213
  Description of Artificial Sequence: Synthetic peptide
  MOD_RES (16)..(16): hCit

SEQ ID NO: 3228 - protein, 38 aa, Artificial Sequence; identical to SEQ ID NO: 3223
  Description of Artificial Sequence: Synthetic peptide
  MOD_RES (16)..(16): Dpr

SEQ ID NO: 3229 - protein, 38 aa, Artificial Sequence; identical to SEQ ID NO: 3223
  Description of Artificial Sequence: Synthetic peptide
  MOD_RES (16)..(16): Dab

SEQ ID NO: 3230 - protein, 38 aa, Artificial Sequence
  Description of Artificial Sequence: Synthetic peptide
GVIINVKCKISAQCLKPCKEAGMRFGKCMAGKCACFGG

SEQ ID NO: 3231 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCHCGGG

SEQ ID NO: 3232 - protein, 38 aa, Artificial Sequence; identical to SEQ ID NO: 3231
  Description of Artificial Sequence: Synthetic peptide
  MOD_RES (16)..(16): hLys

SEQ ID NO: 3233 - protein, 38 aa, Artificial Sequence; identical to SEQ ID NO: 3231
  Description of Artificial Sequence: Synthetic peptide
  MOD_RES (16)..(16): hArg

SEQ ID NO: 3234 - protein, 38 aa, Artificial Sequence; identical to SEQ ID NO: 3231
  Description of Artificial Sequence: Synthetic peptide
  MOD_RES (16)..(16): Cit

SEQ ID NO: 3235 - protein, 38 aa, Artificial Sequence; identical to SEQ ID NO: 3231
  Description of Artificial Sequence: Synthetic peptide
  MOD_RES (16)..(16): hCit

SEQ ID NO: 3236 - protein, 38 aa, Artificial Sequence; identical to SEQ ID NO: 3231
  Description of Artificial Sequence: Synthetic peptide
  MOD_RES (16)..(16): Dpr

SEQ ID NO: 3237 - protein, 38 aa, Artificial Sequence
  Description of Artificial Sequence: Synthetic peptide
  MOD_RES (16)..(16): Orn
GVIINVKCKISAQCLXPCKEAGMRFGKCMAGKCACGGG

SEQ ID NO: 3238 - protein, 38 aa, Artificial Sequence; identical to SEQ ID NO: 3237
  Description of Artificial Sequence: Synthetic peptide
  MOD_RES (16)..(16): hLys

SEQ ID NO: 3239 - protein, 38 aa, Artificial Sequence; identical to SEQ ID NO: 3237
  Description of Artificial Sequence: Synthetic peptide
  MOD_RES (16)..(16): hArg

SEQ ID NO: 3240 - protein, 38 aa, Artificial Sequence; identical to SEQ ID NO: 3237
  Description of Artificial Sequence: Synthetic peptide
  MOD_RES (16)..(16): Cit

SEQ ID NO: 3241 - protein, 37 aa, Artificial Sequence
  Description of Artificial Sequence: Synthetic peptide
  MOD_RES (16)..(16): hCit
GVIINVKCKISAQCLXPCKEAGMRFGKCMAGKCACTP

SEQ ID NO: 3242 - protein, 37 aa, Artificial Sequence; identical to SEQ ID NO: 3241
  Description of Artificial Sequence: Synthetic peptide
  MOD_RES (16)..(16): Dpr

SEQ ID NO: 3243 - protein, 37 aa, Artificial Sequence; identical to SEQ ID NO: 3241
  Description of Artificial Sequence: Synthetic peptide
  MOD_RES (16)..(16): Dab

SEQ ID NO: 3244 - protein, 38 aa, Artificial Sequence; identical to SEQ ID NO: 3116
  Description of Artificial Sequence: Synthetic peptide
  MOD_RES (16)..(16): Orn
  c-term amidation

SEQ ID NO: 3245 - protein, 38 aa, Artificial Sequence; identical to SEQ ID NO: 3116
  Description of Artificial Sequence: Synthetic peptide
  MOD_RES (16)..(16): hLys
  c-term amidation

SEQ ID NO: 3246 - protein, 38 aa, Artificial Sequence; identical to SEQ ID NO: 3116
  Description of Artificial Sequence: Synthetic peptide
  MOD_RES (16)..(16): hArg
  c-term amidation

SEQ ID NO: 3247 - protein, 38 aa, Artificial Sequence; identical to SEQ ID NO: 3116
  Description of Artificial Sequence: Synthetic peptide
  MOD_RES (16)..(16): Cit
  c-term amidation

SEQ ID NO: 3248 - protein, 38 aa, Artificial Sequence; identical to SEQ ID NO: 3116
  Description of Artificial Sequence: Synthetic peptide
  MOD_RES (16)..(16): hCit
  c-term amidation

SEQ ID NO: 3249 - protein, 38 aa, Artificial Sequence; identical to SEQ ID NO: 3116
  Description of Artificial Sequence: Synthetic peptide
  MOD_RES (16)..(16): Dpr
  c-term amidation

SEQ ID NO: 3250 - protein, 38 aa, Artificial Sequence; identical to SEQ ID NO: 3116
  Description of Artificial Sequence: Synthetic peptide
  MOD_RES (16)..(16): Dab
  c-term amidation

SEQ ID NO: 3251 - protein, 38 aa, Artificial Sequence; identical to SEQ ID NO: 3123
  Description of Artificial Sequence: Synthetic peptide
  MOD_RES (16)..(16): Orn
  c-term amidation

SEQ ID NO: 3252 - protein, 38 aa, Artificial Sequence; identical to SEQ ID NO: 3123
  Description of Artificial Sequence: Synthetic peptide
  MOD_RES (16)..(16): hLys
  c-term amidation

SEQ ID NO: 3253 - protein, 38 aa, Artificial Sequence; identical to SEQ ID NO: 3123
  Description of Artificial Sequence: Synthetic peptide
  MOD_RES (16)..(16): hArg
  c-term amidation

SEQ ID NO: 3254 - protein, 38 aa, Artificial Sequence; identical to SEQ ID NO: 3123
  Description of Artificial Sequence: Synthetic peptide
  MOD_RES (16)..(16): Cit
  c-term amidation

SEQ ID NO: 3255 - protein, 38 aa, Artificial Sequence; identical to SEQ ID NO: 3123
  Description of Artificial Sequence: Synthetic peptide
  MOD_RES (16)..(16): hCit
  c-term amidation

SEQ ID NO: 3256 - protein, 38 aa, Artificial Sequence; identical to SEQ ID NO: 3123
  Description of Artificial Sequence: Synthetic peptide
  MOD_RES (16)..(16): Dpr
  c-term amidation

SEQ ID NO: 3257 - protein, 38 aa, Artificial Sequence; identical to SEQ ID NO: 3123
  Description of Artificial Sequence: Synthetic peptide
  MOD_RES (16)..(16): Dab
  c-term amidation

SEQ ID NO: 3258 - protein, 38 aa, Artificial Sequence
  Description of Artificial Sequence: Synthetic peptide
  MOD_RES (16)..(16): Orn
  c-term amidation
GVIINVKCKISAQCLXPCKDAGMRFGKCMAGKCACTPK

SEQ ID NO: 3259 - protein, 38 aa, Artificial Sequence; identical to SEQ ID NO: 3258
  Description of Artificial Sequence: Synthetic peptide
  MOD_RES (16)..(16): hLys
  c-term amidation

SEQ ID NO: 3260 - protein, 38 aa, Artificial Sequence; identical to SEQ ID NO: 3258
  Description of Artificial Sequence: Synthetic peptide
  MOD_RES (16)..(16): hArg
  c-term amidation

SEQ ID NO: 3261 - protein, 38 aa, Artificial Sequence; identical to SEQ ID NO: 3258
  Description of Artificial Sequence: Synthetic peptide
  MOD_RES (16)..(16): Cit
  c-term amidation

SEQ ID NO: 3262 - protein, 38 aa, Artificial Sequence; identical to SEQ ID NO: 3258
  Description of Artificial Sequence: Synthetic peptide
  MOD_RES (16)..(16): hCit
  c-term amidation

SEQ ID NO: 3263 - protein, 38 aa, Artificial Sequence; identical to SEQ ID NO: 3258
  Description of Artificial Sequence: Synthetic peptide
  MOD_RES (16)..(16): Dpr
  c-term amidation

SEQ ID NO: 3264 - protein, 38 aa, Artificial Sequence; identical to SEQ ID NO: 3258
  Description of Artificial Sequence: Synthetic peptide
  MOD_RES (16)..(16): Dab
  c-term amidation

SEQ ID NO: 3265 - protein, 35 aa, Artificial Sequence; identical to SEQ ID NO: 3133
  Description of Artificial Sequence: Synthetic peptide
  MOD_RES (16)..(16): Orn
  c-term amidation

SEQ ID NO: 3266 - protein, 35 aa, Artificial Sequence; identical to SEQ ID NO: 3133
  Description of Artificial Sequence: Synthetic peptide
  MOD_RES (16)..(16): hLys
  c-term amidation

SEQ ID NO: 3267 - protein, 35 aa, Artificial Sequence; identical to SEQ ID NO: 3133
  Description of Artificial Sequence: Synthetic peptide
  MOD_RES (16)..(16): hArg
  c-term amidation

SEQ ID NO: 3268 - protein, 35 aa, Artificial Sequence; identical to SEQ ID NO: 3133
  Description of Artificial Sequence: Synthetic peptide
  MOD_RES (16)..(16): Cit
  c-term amidation

SEQ ID NO: 3269 - protein, 35 aa, Artificial Sequence; identical to SEQ ID NO: 3133
  Description of Artificial Sequence: Synthetic peptide
  MOD_RES (16)..(16): hCit
  c-term amidation

SEQ ID NO: 3270 - protein, 35 aa, Artificial Sequence; identical to SEQ ID NO: 3133
  Description of Artificial Sequence: Synthetic peptide
  MOD_RES (16)..(16): Dpr
  c-term amidation

SEQ ID NO: 3271 - protein, 33 aa, Artificial Sequence
  Description of Artificial Sequence: Synthetic peptide
  MOD_RES (16)..(16): Orn
  c-term amidation
GVIINVKCKISAQCLXPCKDAGMRFGKCMAGKC

SEQ ID NO: 3272 - protein, 33 aa, Artificial Sequence; identical to SEQ ID NO: 3271
  Description of Artificial Sequence: Synthetic peptide
  MOD_RES (16)..(16): hLys
  c-term amidation

SEQ ID NO: 3273 - protein, 33 aa, Artificial Sequence; identical to SEQ ID NO: 3271
  Description of Artificial Sequence: Synthetic peptide
  MOD_RES (16)..(16): hArg
  c-term amidation

SEQ ID NO: 3274 - protein, 33 aa, Artificial Sequence; identical to SEQ ID NO: 3271
  Description of Artificial Sequence: Synthetic peptide
  MOD_RES (16)..(16): Cit
  c-term amidation

SEQ ID NO: 3275 - protein, 35 aa, Artificial Sequence; identical to SEQ ID NO: 3133
  Description of Artificial Sequence: Synthetic peptide
  MOD_RES (16)..(16): hCit
  c-term amidation

SEQ ID NO: 3276 - protein, 33 aa, Artificial Sequence; identical to SEQ ID NO: 3271
  Description of Artificial Sequence: Synthetic peptide
  MOD_RES (16)..(16): Dpr
  c-term amidation

SEQ ID NO: 3277 - protein, 33 aa, Artificial Sequence; identical to SEQ ID NO: 3271
  Description of Artificial Sequence: Synthetic peptide
  MOD_RES (16)..(16): Dab
  c-term amidation

SEQ ID NO: 3278 - protein, 38 aa, Artificial Sequence
  Description of Artificial Sequence: Synthetic peptide
  c-term amidation
GVIINVKCKISAQCLKPCKDAGMRFGKCMAGKCHCYGG

SEQ ID NO: 3279 - protein, 38 aa, Artificial Sequence; identical to SEQ ID NO: 3147
  Description of Artificial Sequence: Synthetic peptide
  MOD_RES (16)..(16): Orn
  c-term amidation

SEQ ID NO: 3280 - protein, 38 aa, Artificial Sequence; identical to SEQ ID NO: 3147
  Description of Artificial Sequence: Synthetic peptide
  MOD_RES (16)..(16): hLys
  c-term amidation

SEQ ID NO: 3281 - protein, 38 aa, Artificial Sequence; identical to SEQ ID NO: 3147
  Description of Artificial Sequence: Synthetic peptide
  MOD_RES (16)..(16): hArg
  c-term amidation

SEQ ID NO: 3282 - protein, 38 aa, Artificial Sequence; identical to SEQ ID NO: 3147
  Description of Artificial Sequence: Synthetic peptide
  MOD_RES (16)..(16): Cit
  c-term amidation

SEQ ID NO: 3283 - protein, 38 aa, Artificial Sequence; identical to SEQ ID NO: 3147
  Description of Artificial Sequence: Synthetic peptide
  MOD_RES (16)..(16): hCit
  c-term amidation

SEQ ID NO: 3284 - protein, 38 aa, Artificial Sequence; identical to SEQ ID NO: 3147
  Description of Artificial Sequence: Synthetic peptide
  MOD_RES (16)..(16): Dpr
  c-term amidation

SEQ ID NO: 3285 - protein, 38 aa, Artificial Sequence
  Description of Artificial Sequence: Synthetic peptide
  c-term amidation
GVIINVKCKISAQCLKPCKDAGMRFGKCMAGKCHCFGG

SEQ ID NO: 3286 - protein, 37 aa, Artificial Sequence
  Description of Artificial Sequence: Synthetic peptide
  c-term amidation
GVIINVKCKISAQCLKPCKDAGMRFGKCMAGKCHCYG

SEQ ID NO: 3287 - protein, 37 aa, Artificial Sequence; identical to SEQ ID NO: 3161
  Description of Artificial Sequence: Synthetic peptide
  c-term amidation

SEQ ID NO: 3288 - protein, 38 aa, Artificial Sequence; identical to SEQ ID NO: 3154
  Description of Artificial Sequence: Synthetic peptide
  MOD_RES (16)..(16): Orn
  c-term amidation

SEQ ID NO: 3289 - protein, 38 aa, Artificial Sequence; identical to SEQ ID NO: 3154
  Description of Artificial Sequence: Synthetic peptide
  MOD_RES (16)..(16): hLys
  c-term amidation

SEQ ID NO: 3290 - protein, 38 aa, Artificial Sequence; identical to SEQ ID NO: 3154
  Description of Artificial Sequence: Synthetic peptide
  MOD_RES (16)..(16): hArg
  c-term amidation

SEQ ID NO: 3291 - protein, 38 aa, Artificial Sequence; identical to SEQ ID NO: 3154
  Description of Artificial Sequence: Synthetic peptide
  MOD_RES (16)..(16): Cit
  c-term amidation

SEQ ID NO: 3292 - protein, 38 aa, Artificial Sequence; identical to SEQ ID NO: 3154
  Description of Artificial Sequence: Synthetic peptide
  MOD_RES (16)..(16): hCit
  c-term amidation

SEQ ID NO: 3293 - protein, 38 aa, Artificial Sequence; identical to SEQ ID NO: 3154
  Description of Artificial Sequence: Synthetic peptide
  MOD_RES (16)..(16): Dpr
  c-term amidation

SEQ ID NO: 3294 - protein, 38 aa, Artificial Sequence; identical to SEQ ID NO: 3154
  Description of Artificial Sequence: Synthetic peptide
  MOD_RES (16)..(16): Dab
  c-term amidation

SEQ ID NO: 3295 - protein, 38 aa, Artificial Sequence; identical to SEQ ID NO: 3153
  Description of Artificial Sequence: Synthetic peptide
  c-term amidation

SEQ ID NO: 3296 - protein, 38 aa, Artificial Sequence; identical to SEQ ID NO: 3162
  Description of Artificial Sequence: Synthetic peptide
  MOD_RES (16)..(16): Orn
  c-term amidation

SEQ ID NO: 3297 - protein, 38 aa, Artificial Sequence; identical to SEQ ID NO: 3162
  Description of Artificial Sequence: Synthetic peptide
  MOD_RES (16)..(16): hLys
  c-term amidation

SEQ ID NO: 3298 - protein, 38 aa, Artificial Sequence; identical to SEQ ID NO: 3162
  Description of Artificial Sequence: Synthetic peptide
  MOD_RES (16)..(16): hArg
  c-term amidation

SEQ ID NO: 3299 - protein, 38 aa, Artificial Sequence; identical to SEQ ID NO: 3162
  Description of Artificial Sequence: Synthetic peptide
  MOD_RES (16)..(16): Cit
  c-term amidation

SEQ ID NO: 3300 - protein, 38 aa, Artificial Sequence; identical to SEQ ID NO: 3162
  Description of Artificial Sequence: Synthetic peptide
  MOD_RES (16)..(16): hCit
  c-term amidation

SEQ ID NO: 3301 - protein, 38 aa, Artificial Sequence; identical to SEQ ID NO: 3162
  Description of Artificial Sequence: Synthetic peptide
  MOD_RES (16)..(16): Dpr
  c-term amidation

SEQ ID NO: 3302 - protein, 38 aa, Artificial Sequence
  Description of Artificial Sequence: Synthetic peptide
  c-term amidation
GVIINVKCKISAQCLKPCKDAGMRFGKCMAGKCACGGG

SEQ ID NO: 3303 - protein, 38 aa, Artificial Sequence
  Description of Artificial Sequence: Synthetic peptide
  MOD_RES (16)..(16): Orn
  c-term amidation
GVIINVKCKISAQCLXPCKDAGMRFGKCMAGKCACFGG

SEQ ID NO: 3304 - protein, 38 aa, Artificial Sequence; identical to SEQ ID NO: 3169
  Description of Artificial Sequence: Synthetic peptide
  MOD_RES (16)..(16): Orn
  c-term amidation

SEQ ID NO: 3305 - protein, 38 aa, Artificial Sequence; identical to SEQ ID NO: 3169
  Description of Artificial Sequence: Synthetic peptide
  MOD_RES (16)..(16): hLys
  c-term amidation

SEQ ID NO: 3306 - protein, 38 aa, Artificial Sequence; identical to SEQ ID NO: 3169
  Description of Artificial Sequence: Synthetic peptide
  MOD_RES (16)..(16): hArg
  c-term amidation

SEQ ID NO: 3307 - protein, 38 aa, Artificial Sequence; identical to SEQ ID NO: 3169
  Description of Artificial Sequence: Synthetic peptide
  MOD_RES (16)..(16): Cit
  c-term amidation

SEQ ID NO: 3308 - protein, 38 aa, Artificial Sequence; identical to SEQ ID NO: 3169
  Description of Artificial Sequence: Synthetic peptide
  MOD_RES (16)..(16): hCit
  c-term amidation

SEQ ID NO: 3309 - protein, 38 aa, Artificial Sequence; identical to SEQ ID NO: 3169
  Description of Artificial Sequence: Synthetic peptide
  MOD_RES (16)..(16): Dpr
  c-term amidation

SEQ ID NO: 3310 - protein, 38 aa, Artificial Sequence; identical to SEQ ID NO: 3169
  Description of Artificial Sequence: Synthetic peptide
  MOD_RES (16)..(16): Dab
  c-term amidation

SEQ ID NO: 3311 - protein, 38 aa, Artificial Sequence; identical to SEQ ID NO: 3179
  Description of Artificial Sequence: Synthetic peptide
  MOD_RES (16)..(16): Orn
  c-term amidation

SEQ ID NO: 3312 - protein, 38 aa, Artificial Sequence; identical to SEQ ID NO: 3179
  Description of Artificial Sequence: Synthetic peptide
  MOD_RES (16)..(16): hLys
  c-term amidation

SEQ ID NO: 3313 - protein, 38 aa, Artificial Sequence; identical to SEQ ID NO: 3179
  Description of Artificial Sequence: Synthetic peptide
  MOD_RES (16)..(16): hArg
  c-term amidation

SEQ ID NO: 3314 - protein, 38 aa, Artificial Sequence; identical to SEQ ID NO: 3179
  Description of Artificial Sequence: Synthetic peptide
  MOD_RES (16)..(16): Cit
  c-term amidation

SEQ ID NO: 3315 - protein, 38 aa, Artificial Sequence; identical to SEQ ID NO: 3179
  Description of Artificial Sequence: Synthetic peptide
  MOD_RES (16)..(16): hCit
  c-term amidation

SEQ ID NO: 3316 - protein, 38 aa, Artificial Sequence; identical to SEQ ID NO: 3179
  Description of Artificial Sequence: Synthetic peptide
  MOD_RES (16)..(16): Dpr
  c-term amidation

SEQ ID NO: 3317 - protein, 38 aa, Artificial Sequence; identical to SEQ ID NO: 3179
  Description of Artificial Sequence: Synthetic peptide
  MOD_RES (16)..(16): Dab
  c-term amidation

SEQ ID NO: 3318 - protein, 38 aa, Artificial Sequence; identical to SEQ ID NO: 3185
  Description of Artificial Sequence: Synthetic peptide
  MOD_RES (16)..(16): Orn
  c-term amidation

SEQ ID NO: 3319 - protein, 38 aa, Artificial Sequence; identical to SEQ ID NO: 3185
  Description of Artificial Sequence: Synthetic peptide
  MOD_RES (16)..(16): hLys
  c-term amidation

SEQ ID NO: 3320 - protein, 38 aa, Artificial Sequence; identical to SEQ ID NO: 3185
  Description of Artificial Sequence: Synthetic peptide
  MOD_RES (16)..(16): hArg
  c-term amidation

SEQ ID NO: 3321 - protein, 38 aa, Artificial Sequence; identical to SEQ ID NO: 3185
  Description of Artificial Sequence: Synthetic peptide
  MOD_RES (16)..(16): Cit
  c-term amidation

SEQ ID NO: 3322 - protein, 38 aa, Artificial Sequence; identical to SEQ ID NO: 3185
  Description of Artificial Sequence: Synthetic peptide
  MOD_RES (16)..(16): hCit
  c-term amidation

SEQ ID NO: 3323 - protein, 38 aa, Artificial Sequence; identical to SEQ ID NO: 3185
  Description of Artificial Sequence: Synthetic peptide
  MOD_RES (16)..(16): Dpr
  c-term amidation

SEQ ID NO: 3324 - protein, 38 aa, Artificial Sequence; identical to SEQ ID NO: 3185
  Description of Artificial Sequence: Synthetic peptide
  MOD_RES (16)..(16): Dab
  c-term amidation

SEQ ID NO: 3325 - protein, 38 aa, Artificial Sequence; identical to SEQ ID NO: 3192
  Description of Artificial Sequence: Synthetic peptide
  MOD_RES (16)..(16): Orn
  c-term amidation

SEQ ID NO: 3326 - protein, 38 aa, Artificial Sequence; identical to SEQ ID NO: 3192
  Description of Artificial Sequence: Synthetic peptide
  MOD_RES (16)..(16): hLys
  c-term amidation

SEQ ID NO: 3327 - protein, 38 aa, Artificial Sequence; identical to SEQ ID NO: 3192
  Description of Artificial Sequence: Synthetic peptide
  MOD_RES (16)..(16): hArg
  c-term amidation

SEQ ID NO: 3328 - protein, 38 aa, Artificial Sequence; identical to SEQ ID NO: 3192
  Description of Artificial Sequence: Synthetic peptide
  MOD_RES (16)..(16): Cit
  c-term amidation

SEQ ID NO: 3329 - protein, 38 aa, Artificial Sequence; identical to SEQ ID NO: 3192
  Description of Artificial Sequence: Synthetic peptide
  MOD_RES (16)..(16): hCit
  c-term amidation

SEQ ID NO: 3330 - protein, 38 aa, Artificial Sequence; identical to SEQ ID NO: 3192
  Description of Artificial Sequence: Synthetic peptide
  MOD_RES (16)..(16): Dpr
  c-term amidation

SEQ ID NO: 3331 - protein, 38 aa, Artificial Sequence; identical to SEQ ID NO: 3192
  Description of Artificial Sequence: Synthetic peptide
  MOD_RES (16)..(16): Dab
  c-term amidation

SEQ ID NO: 3332 - protein, 35 aa, Artificial Sequence; identical to SEQ ID NO: 3199
  Description of Artificial Sequence: Synthetic peptide
  MOD_RES (16)..(16): Orn
  c-term amidation

SEQ ID NO: 3333 - protein, 35 aa, Artificial Sequence; identical to SEQ ID NO: 3199
  Description of Artificial Sequence: Synthetic peptide
  MOD_RES (16)..(16): hLys
  c-term amidation

SEQ ID NO: 3334 - protein, 35 aa, Artificial Sequence; identical to SEQ ID NO: 3199
  Description of Artificial Sequence: Synthetic peptide
  MOD_RES (16)..(16): hArg
  c-term amidation

SEQ ID NO: 3335 - protein, 35 aa, Artificial Sequence; identical to SEQ ID NO: 3199
  Description of Artificial Sequence: Synthetic peptide
  MOD_RES (16)..(16): Cit
  c-term amidation

SEQ ID NO: 3336 - protein, 35 aa, Artificial Sequence; identical to SEQ ID NO: 3199
  Description of Artificial Sequence: Synthetic peptide
  MOD_RES (16)..(16): hCit
  c-term amidation

SEQ ID NO: 3337 - protein, 35 aa, Artificial Sequence; identical to SEQ ID NO: 3199
  Description of Artificial Sequence: Synthetic peptide
  MOD_RES (16)..(16): Dpr
  c-term amidation

SEQ ID NO: 3338 - protein, 33 aa, Artificial Sequence
  Description of Artificial Sequence: Synthetic peptide
  MOD_RES (16)..(16): Orn
  c-term amidation
GVIINVKCKISAQCLXPCKEAGMRFGKCMAGKC

SEQ ID NO: 3339 - protein, 33 aa, Artificial Sequence; identical to SEQ ID NO: 3338
  Description of Artificial Sequence: Synthetic peptide
  MOD_RES (16)..(16): hLys
  c-term amidation

SEQ ID NO: 3340 - protein, 33 aa, Artificial Sequence; identical to SEQ ID NO: 3338
  Description of Artificial Sequence: Synthetic peptide
  MOD_RES (16)..(16): hArg
  c-term amidation

SEQ ID NO: 3341 - protein, 33 aa, Artificial Sequence; identical to SEQ ID NO: 3338
  Description of Artificial Sequence: Synthetic peptide
  MOD_RES (16)..(16): Cit
  c-term amidation

SEQ ID NO: 3342 - protein, 35 aa, Artificial Sequence; identical to SEQ ID NO: 3199
  Description of Artificial Sequence: Synthetic peptide
  MOD_RES (16)..(16): hCit
  c-term amidation

SEQ ID NO: 3343 - protein, 33 aa, Artificial Sequence; identical to SEQ ID NO: 3338
  Description of Artificial Sequence: Synthetic peptide
  MOD_RES (16)..(16): Dpr
  c-term amidation

SEQ ID NO: 3344 - protein, 33 aa, Artificial Sequence; identical to SEQ ID NO: 3338
  Description of Artificial Sequence: Synthetic peptide
  MOD_RES (16)..(16): Dab
  c-term amidation

SEQ ID NO: 3345 - protein, 38 aa, Artificial Sequence
  Description of Artificial Sequence: Synthetic peptide
  c-term amidation
GVIINVKCKISAQCLKPCKEAGMRFGKCMAGKCHCWGG

SEQ ID NO: 3346 - protein, 38 aa, Artificial Sequence; identical to SEQ ID NO: 3213
  Description of Artificial Sequence: Synthetic peptide
  MOD_RES (16)..(16): Orn
  c-term amidation

SEQ ID NO: 3347 - protein, 38 aa, Artificial Sequence; identical to SEQ ID NO: 3213
  Description of Artificial Sequence: Synthetic peptide
  MOD_RES (16)..(16): hLys
  c-term amidation

SEQ ID NO: 3348 - protein, 38 aa, Artificial Sequence; identical to SEQ ID NO: 3213
  Description of Artificial Sequence: Synthetic peptide
  MOD_RES (16)..(16): hArg
  c-term amidation

SEQ ID NO: 3349 - protein, 38 aa, Artificial Sequence; identical to SEQ ID NO: 3213
  Description of Artificial Sequence: Synthetic peptide
  MOD_RES (16)..(16): Cit
  c-term amidation

SEQ ID NO: 3350 - protein, 38 aa, Artificial Sequence; identical to SEQ ID NO: 3213
  Description of Artificial Sequence: Synthetic peptide
  MOD_RES (16)..(16): hCit
  c-term amidation

SEQ ID NO: 3351 - protein, 38 aa, Artificial Sequence; identical to SEQ ID NO: 3213
  Description of Artificial Sequence: Synthetic peptide
  MOD_RES (16)..(16): Dpr
  c-term amidation

SEQ ID NO: 3352 - protein, 38 aa, Artificial Sequence; identical to SEQ ID NO: 3213
  Description of Artificial Sequence: Synthetic peptide
  MOD_RES (16)..(16): Dab
  c-term amidation

SEQ ID NO: 3353 - protein, 38 aa, Artificial Sequence
  Description of Artificial Sequence: Synthetic peptide
  c-term amidation
GVIINVKCKISAQCLKPCKEAGMRFGKCMAGKCACYGG

SEQ ID NO: 3354 - protein, 38 aa, Artificial Sequence; identical to SEQ ID NO: 3223
  Description of Artificial Sequence: Synthetic peptide
  MOD_RES (16)..(16): Orn
  c-term amidation

SEQ ID NO: 3355 - protein, 38 aa, Artificial Sequence; identical to SEQ ID NO: 3223
  Description of Artificial Sequence: Synthetic peptide
  MOD_RES (16)..(16): hLys
  c-term amidation

SEQ ID NO: 3356 - protein, 38 aa, Artificial Sequence; identical to SEQ ID NO: 3223
  Description of Artificial Sequence: Synthetic peptide
  MOD_RES (16)..(16): hArg
  c-term amidation

SEQ ID NO: 3357 - protein, 38 aa, Artificial Sequence; identical to SEQ ID NO: 3223
  Description of Artificial Sequence: Synthetic peptide
  MOD_RES (16)..(16): Cit
  c-term amidation

SEQ ID NO: 3358 - protein, 38 aa, Artificial Sequence; identical to SEQ ID NO: 3213
  Description of Artificial Sequence: Synthetic peptide
  MOD_RES (16)..(16): hCit
  c-term amidation

SEQ ID NO: 3359 - protein, 38 aa, Artificial Sequence; identical to SEQ ID NO: 3223
  Description of Artificial Sequence: Synthetic peptide
  MOD_RES (16)..(16): Dpr
  c-term amidation

SEQ ID NO: 3360 - protein, 38 aa, Artificial Sequence; identical to SEQ ID NO: 3223
  Description of Artificial Sequence: Synthetic peptide
  MOD_RES (16)..(16): Dab
  c-term amidation

SEQ ID NO: 3361 - protein, 38 aa, Artificial Sequence; identical to SEQ ID NO: 3231
  Description of Artificial Sequence: Synthetic peptide
  MOD_RES (16)..(16): Orn
  c-term amidation

SEQ ID NO: 3362 - protein, 38 aa, Artificial Sequence; identical to SEQ ID NO: 3231
  Description of Artificial Sequence: Synthetic peptide
  MOD_RES (16)..(16): hLys
  c-term amidation

SEQ ID NO: 3363 - protein, 38 aa, Artificial Sequence; identical to SEQ ID NO: 3231
  Description of Artificial Sequence: Synthetic peptide
  MOD_RES (16)..(16): hArg
  c-term amidation

SEQ ID NO: 3364 - protein, 38 aa, Artificial Sequence; identical to SEQ ID NO: 3231
  Description of Artificial Sequence: Synthetic peptide
  MOD_RES (16)..(16): Cit
  c-term amidation

SEQ ID NO: 3365 - protein, 38 aa, Artificial Sequence; identical to SEQ ID NO: 3231
  Description of Artificial Sequence: Synthetic peptide
  MOD_RES (16)..(16): hCit
  c-term amidation

SEQ ID NO: 3366 - protein, 38 aa, Artificial Sequence; identical to SEQ ID NO: 3231
  Description of Artificial Sequence: Synthetic peptide
  MOD_RES (16)..(16): Dpr
  c-term amidation

SEQ ID NO: 3367 - protein, 38 aa, Artificial Sequence; identical to SEQ ID NO: 3237
  Description of Artificial Sequence: Synthetic peptide
  MOD_RES (16)..(16): Orn
  c-term amidation

SEQ ID NO: 3368 - protein, 38 aa, Artificial Sequence; identical to SEQ ID NO: 3237
  Description of Artificial Sequence: Synthetic peptide
  MOD_RES (16)..(16): hLys
  c-term amidation

SEQ ID NO: 3369 - protein, 38 aa, Artificial Sequence; identical to SEQ ID NO: 3237
  Description of Artificial Sequence: Synthetic peptide
  MOD_RES (16)..(16): hArg
  c-term amidation

SEQ ID NO: 3370 - protein, 38 aa, Artificial Sequence; identical to SEQ ID NO: 3237
  Description of Artificial Sequence: Synthetic peptide
  MOD_RES (16)..(16): Cit
  c-term amidation

SEQ ID NO: 3371 - protein, 37 aa, Artificial Sequence; identical to SEQ ID NO: 3241
  Description of Artificial Sequence: Synthetic peptide
  MOD_RES (16)..(16): hCit
  c-term amidation

SEQ ID NO: 3372 - protein, 38 aa, Artificial Sequence; identical to SEQ ID NO: 3237
  Description of Artificial Sequence: Synthetic peptide
  MOD_RES (16)..(16): Dpr
  c-term amidation

SEQ ID NO: 3373 - protein, 38 aa, Artificial Sequence; identical to SEQ ID NO: 3237
  Description of Artificial Sequence: Synthetic peptide
  MOD_RES (16)..(16): Dab
  c-term amidation

SEQ ID NO: 3374 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCMAGKCACYGG

SEQ ID NO: 3375 - protein, 38 aa, Artificial Sequence
  Description of Artificial Sequence: Synthetic peptide
  MOD_RES (20)..(20): Cpa
  c-term amidation
GVIINVKCKISAQCLKPCKXAGMRFGKCMAGKCACGGG

SEQ ID NO: 3376 - protein, 36 aa, Artificial Sequence
  Description of Artificial Sequence: Synthetic peptide
  MOD_RES (20)..(20): Cpa
  c-term amidation
GVIINVKCKISAQCLKPCKXAGMRFGKCMAGKCACY

SEQ ID NO: 3377 - protein, 38 aa, Artificial Sequence; identical to SEQ ID NO: 3153
  Description of Artificial Sequence: Synthetic peptide
  n-term acetylation
  c-term amidation

SEQ ID NO: 3378 - protein, 38 aa, Artificial Sequence; identical to SEQ ID NO: 3374
  Description of Artificial Sequence: Synthetic peptide
  MOD_RES (20)..(20): Aad
  c-term amidation

SEQ ID NO: 3379 - protein, 38 aa, Artificial Sequence
  Description of Artificial Sequence: Synthetic peptide
  MOD_RES (20)..(20): Aad
  c-term amidation
GVIINVKCKISAQCLKPCKXAGMRFGKCMAGKCHCYGG

SEQ ID NO: 3380 - protein, 38 aa, Artificial Sequence; identical to SEQ ID NO: 3374
  Description of Artificial Sequence: Synthetic peptide
  MOD_RES (20)..(20): Aad
  c-term amidation

SEQ ID NO: 3381 - protein, 38 aa, Artificial Sequence
  Description of Artificial Sequence: Synthetic peptide
  c-term amidation
GVIINVKCKISAQCLHPCKDAGMRFGKCMAGKCACYGG

SEQ ID NO: 3382 - protein, 38 aa, Artificial Sequence; identical to SEQ ID NO: 3381
  Description of Artificial Sequence: Synthetic peptide
  c-term amidation

SEQ ID NO: 3383 - protein, 36 aa, Artificial Sequence
  Description of Artificial Sequence: Synthetic peptide
  c-term amidation
GVIINVKCKISAQCLHPCKDAGMRFGKCMAGKCACY

SEQ ID NO: 3384 - protein, 38 aa, Artificial Sequence
  Description of Artificial Sequence: Synthetic peptide
  c-term amidation
GVIINVKCKISAQCLHPCKDAGMRFGKCMAGKCHCYGG

SEQ ID NO: 3385 - protein, 38 aa, Artificial Sequence; identical to SEQ ID NO: 3384
  Description of Artificial Sequence: Synthetic peptide

SEQ ID NO: 3386 - protein, 38 aa, Artificial Sequence
  Description of Artificial Sequence: Synthetic peptide
  c-term amidation
GVIINVKCKISAQCLHPCKDAGMRFGKCMAGKCHCYPK

SEQ ID NO: 3387 - protein, 35 aa, Artificial Sequence
  Description of Artificial Sequence: Synthetic peptide
GVIINVKCKISAQCLHPCKDAGMRFGKCMAGKCAC

SEQ ID NO: 3388 - protein, 38 aa, Artificial Sequence
  Description of Artificial Sequence: Synthetic peptide
  MOD_RES (36)..(36): 1Nal
  c-term amidation
GVIINVKCKISAQCLKPCKDAGMRFGKCMAGKCACXGG

SEQ ID NO: 3389 - protein, 38 aa, Artificial Sequence
  Description of Artificial Sequence: Synthetic peptide
  MOD_RES (36)..(36): 1Nal
  c-term amidation
GVIINVKCKISAQCLKPCKDAGMRFGKCMAGKCACXPK

SEQ ID NO: 3390 - protein, 38 aa, Artificial Sequence; identical to SEQ ID NO: 3388
  Description of Artificial Sequence: Synthetic peptide
  MOD_RES (36)..(36): 2Nal
  c-term amidation

SEQ ID NO: 3391 - protein, 38 aa, Artificial Sequence; identical to SEQ ID NO: 3388
  Description of Artificial Sequence: Synthetic peptide
  MOD_RES (36)..(36): Cha
  c-term amidation

SEQ ID NO: 3392 - protein, 38 aa, Artificial Sequence; identical to SEQ ID NO: 3388
  Description of Artificial Sequence: Synthetic peptide
  MOD_RES (36)..(36): MePhe
  c-term amidation

SEQ ID NO: 3393 - protein, 38 aa, Artificial Sequence; identical to SEQ ID NO: 3388
  Description of Artificial Sequence: Synthetic peptide
  MOD_RES (36)..(36): BiPhA
  c-term amidation

SEQ ID NO: 3394 - protein, 38 aa, Artificial Sequence
  Description of Artificial Sequence: Synthetic peptide
  MOD_RES (34)..(34): Aib
  c-term amidation
GVIINVKCKISAQCLKPCKDAGMRFGKCMAGKCXCYGG

SEQ ID NO: 3395 - protein, 38 aa, Artificial Sequence; identical to SEQ ID NO: 3394
  Description of Artificial Sequence: Synthetic peptide
  MOD_RES (34)..(34): Abu
  c-term amidation

SEQ ID NO: 3396 - protein, 36 aa, Artificial Sequence
  Description of Artificial Sequence: Synthetic peptide
  MOD_RES (36)..(36): 1Nal
GVIINVKCKISAQCLKPCKDAGMRFGKCMAGKCACX

SEQ ID NO: 3397 - protein, 38 aa, Artificial Sequence
  Description of Artificial Sequence: Synthetic peptide
  MOD_RES (36)..(36): 1Nal
  c-term amidation
GVIINVKCKISAQCLHPCKDAGMRFGKCMAGKCACXGG

SEQ ID NO: 3398 - protein, 36 aa, Artificial Sequence; identical to SEQ ID NO: 3396
  Description of Artificial Sequence: Synthetic peptide
  MOD_RES (36)..(36): 4Bip
  c-term amidation

SEQ ID NO: 3399 - protein, 38 aa, Artificial Sequence; identical to SEQ ID NO: 3397
  Description of Artificial Sequence: Synthetic peptide
  MOD_RES (36)..(36): 4Bip
  c-term amidation

SEQ ID NO: 3400 - protein, 38 aa, Artificial Sequence
  Description of Artificial Sequence: Synthetic peptide
GVIINVKCKISAQCLKPCKDAGMRFGKCMAGKCHCGGG

SEQ ID NO: 3401 - protein, 38 aa, Artificial Sequence; identical to SEQ ID NO: 1423
  Description of Artificial Sequence: Synthetic peptide

SEQ ID NO: 3402 - protein, 38 aa, Artificial Sequence
  Description of Artificial Sequence: Synthetic peptide
GVIINVSCKISRQCLEPCKKAGMRFGACMNGKCHCTPK

SEQ ID NO: 3403 - protein, 38 aa, Artificial Sequence
  Description of Artificial Sequence: Synthetic peptide
GVIINVKCKISRQCLKPCKKAGMRFGACMNGKCHCTPK

SEQ ID NO: 3404 - protein, 38 aa, Artificial Sequence
  Description of Artificial Sequence: Synthetic peptide
GVIINVKCKISRQCLEPCKDAGMRFGACMNGKCHCTPK

SEQ ID NO: 3405 - protein, 38 aa, Artificial Sequence
  Description of Artificial Sequence: Synthetic peptide
GVIINVKCKISRQCLKPCKDAGMRFGACMNGKCHCTPK

SEQ ID NO: 3406 - protein, 38 aa, Artificial Sequence
  Description of Artificial Sequence: Synthetic peptide
GVIINVSCKISRQCLKPCKDAGMRFGACMNGKCHCTPK

SEQ ID NO: 3407 - protein, 38 aa, Artificial Sequence; identical to SEQ ID NO: 2282
  Description of Artificial Sequence: Synthetic peptide

SEQ ID NO: 3408 - protein, 38 aa, Artificial Sequence
  Description of Artificial Sequence: Synthetic peptide
GVIINVKCKISRQCLKPCKDAGMRFGACMNGKCHCYPK

SEQ ID NO: 3409 - protein, 38 aa, Artificial Sequence; identical to SEQ ID NO: 2282
  Description of Artificial Sequence: Synthetic peptide
  n-term acetylation

SEQ ID NO: 3410 - protein, 38 aa, Artificial Sequence; identical to SEQ ID NO: 2282
  Description of Artificial Sequence: Synthetic peptide
  c-term amidation

SEQ ID NO: 3411 - protein, 38 aa, Artificial Sequence; identical to SEQ ID NO: 2282
  Description of Artificial Sequence: Synthetic peptide
  n-term acetylation
  c-term amidation

SEQ ID NO: 3412 - protein, 38 aa, Artificial Sequence; identical to SEQ ID NO: 3408
  Description of Artificial Sequence: Synthetic peptide
  c-term amidation

SEQ ID NO: 3413 - protein, 38 aa, Artificial Sequence; identical to SEQ ID NO: 3408
  Description of Artificial Sequence: Synthetic peptide
  n-term acetylation

SEQ ID NO: 3414 - protein, 38 aa, Artificial Sequence; identical to SEQ ID NO: 3408
  Description of Artificial Sequence: Synthetic peptide
  n-term acetylation
  c-term amidation

SEQ ID NO: 3415 - protein, 38 aa, Artificial Sequence; identical to SEQ ID NO: 3403
  Description of Artificial Sequence: Synthetic peptide
  c-term amidation

SEQ ID NO: 3416 - protein, 38 aa, Artificial Sequence; identical to SEQ ID NO: 3403
  Description of Artificial Sequence: Synthetic peptide
  n-term acetylation

SEQ ID NO: 3417 - protein, 38 aa, Artificial Sequence; identical to SEQ ID NO: 3403
  Description of Artificial Sequence: Synthetic peptide
  n-term acetylation
  c-term amidation

SEQ ID NO: 3418 - protein, 38 aa, Artificial Sequence; identical to SEQ ID NO: 3404
  Description of Artificial Sequence: Synthetic peptide
  n-term acetylation

SEQ ID NO: 3419 - protein, 38 aa, Artificial Sequence; identical to SEQ ID NO: 3404
  Description of Artificial Sequence: Synthetic peptide
  c-term amidation

SEQ ID NO: 3420 - protein, 38 aa, Artificial Sequence; identical to SEQ ID NO: 3404
  Description of Artificial Sequence: Synthetic peptide
  n-term acetylation
  c-term amidation

SEQ ID NO: 3421 - protein, 38 aa, Artificial Sequence; identical to SEQ ID NO: 1423
  Description of Artificial Sequence: Synthetic peptide
  c-term amidation

SEQ ID NO: 3422 - protein, 38 aa, Artificial Sequence; identical to SEQ ID NO: 1423
  Description of Artificial Sequence: Synthetic peptide
  n-term acetylation

SEQ ID NO: 3423 - protein, 38 aa, Artificial Sequence; identical to SEQ ID NO: 1423
  Description of Artificial Sequence: Synthetic peptide
  n-term acetylation
  c-term amidation

SEQ ID NO: 3424 - protein, 38 aa, Artificial Sequence; identical to SEQ ID NO: 3405
  Description of Artificial Sequence: Synthetic peptide
  c-term amidation

SEQ ID NO: 3425 - protein, 38 aa, Artificial Sequence; identical to SEQ ID NO: 3405
  Description of Artificial Sequence: Synthetic peptide
  n-term acetylation

SEQ ID NO: 3426 - protein, 38 aa, Artificial Sequence; identical to SEQ ID NO: 3405
  Description of Artificial Sequence: Synthetic peptide
  n-term acetylation
  c-term amidation

SEQ ID NO: 3427 - protein, 37 aa, Artificial Sequence
  Description of Artificial Sequence: Synthetic peptide
VIINVKCKISRQCLEPCKKAGMRFGACMNGKCHCTPK

SEQ ID NO: 3428 - protein, 37 aa, Artificial Sequence; identical to SEQ ID NO: 3427
  Description of Artificial Sequence: Synthetic peptide
  n-term acetylation

SEQ ID NO: 3429 - protein, 37 aa, Artificial Sequence; identical to SEQ ID NO: 3427
  Description of Artificial Sequence: Synthetic peptide
  c-term amidation

SEQ ID NO: 3430 - protein, 37 aa, Artificial Sequence; identical to SEQ ID NO: 3427
  Description of Artificial Sequence: Synthetic peptide
  n-term acetylation
  c-term amidation

SEQ ID NO: 3431 - protein, 38 aa, Artificial Sequence
  Description of Artificial Sequence: Synthetic peptide
GVIINVKCKISRQCLEPCKKAGMRFGACMNGKCACTPK

SEQ ID NO: 3432 - protein, 38 aa, Artificial Sequence; identical to SEQ ID NO: 3431
  Description of Artificial Sequence: Synthetic peptide
  n-term acetylation

SEQ ID NO: 3433 - protein, 38 aa, Artificial Sequence; identical to SEQ ID NO: 3431
  Description of Artificial Sequence: Synthetic peptide
  c-term amidation

SEQ ID NO: 3434 - protein, 38 aa, Artificial Sequence; identical to SEQ ID NO: 3431
  Description of Artificial Sequence: Synthetic peptide
  n-term acetylation
  c-term amidation

SEQ ID NO: 3435 - protein, 37 aa, Artificial Sequence
  Description of Artificial Sequence: Synthetic peptide
VIINVKCKISRQCLKPCKDAGMRFGACMNGKCHCTPK

SEQ ID NO: 3436 - protein, 37 aa, Artificial Sequence; identical to SEQ ID NO: 3435
  Description of Artificial Sequence: Synthetic peptide
  n-term acetylation

SEQ ID NO: 3437 - protein, 37 aa, Artificial Sequence; identical to SEQ ID NO: 3435
  Description of Artificial Sequence: Synthetic peptide
  c-term amidation

SEQ ID NO: 3438 - protein, 37 aa, Artificial Sequence; identical to SEQ ID NO: 3435
  Description of Artificial Sequence: Synthetic peptide
  n-term acetylation
  c-term amidation

SEQ ID NO: 3439 - protein, 34 aa, Artificial Sequence
  Description of Artificial Sequence: Synthetic peptide
NVKCKISRQCLKPCKDAGMRFGACMNGKCHCTPK

SEQ ID NO: 3440 - protein, 34 aa, Artificial Sequence; identical to SEQ ID NO: 3439
  Description of Artificial Sequence: Synthetic peptide
  n-term acetylation

SEQ ID NO: 3441 - protein, 34 aa, Artificial Sequence; identical to SEQ ID NO: 3439
  Description of Artificial Sequence: Synthetic peptide
  c-term amidation

SEQ ID NO: 3442 - protein, 34 aa, Artificial Sequence; identical to SEQ ID NO: 3439
  Description of Artificial Sequence: Synthetic peptide
  n-term acetylation
  c-term amidation

SEQ ID NO: 3443 - protein, 32 aa, Artificial Sequence
  Description of Artificial Sequence: Synthetic peptide
KCKISRQCLKPCKDAGMRFGACMNGKCHCTPK

SEQ ID NO: 3444 - protein, 32 aa, Artificial Sequence; identical to SEQ ID NO: 3443
  Description of Artificial Sequence: Synthetic peptide
  n-term acetylation

SEQ ID NO: 3445 - protein, 32 aa, Artificial Sequence; identical to SEQ ID NO: 3443
  Description of Artificial Sequence: Synthetic peptide
  c-term amidation

SEQ ID NO: 3446 - protein, 32 aa, Artificial Sequence; identical to SEQ ID NO: 3443
  Description of Artificial Sequence: Synthetic peptide
  n-term acetylation
  c-term amidation

SEQ ID NO: 3447 - protein, 31 aa, Artificial Sequence
  Description of Artificial Sequence: Synthetic peptide
CKISRQCLKPCKDAGMRFGACMNGKCHCTPK

SEQ ID NO: 3448 - protein, 31 aa, Artificial Sequence; identical to SEQ ID NO: 3447
  Description of Artificial Sequence: Synthetic peptide
  n-term acetylation

SEQ ID NO: 3449 - protein, 31 aa, Artificial Sequence; identical to SEQ ID NO: 3447
  Description of Artificial Sequence: Synthetic peptide
  c-term amidation

SEQ ID NO: 3450 - protein, 31 aa, Artificial Sequence; identical to SEQ ID NO: 3447
  Description of Artificial Sequence: Synthetic peptide
  n-term acetylation
  c-term amidation

SEQ ID NO: 3451 - protein, 38 aa, Artificial Sequence
  Description of Artificial Sequence: Synthetic peptide
GVIINVKCKISRQCLKPCKDAGMRNGACMNGKCHCTPK

SEQ ID NO: 3452 - protein, 38 aa, Artificial Sequence; identical to SEQ ID NO: 3451
  Description of Artificial Sequence: Synthetic peptide
  c-term amidation

SEQ ID NO: 3453 - protein, 38 aa, Artificial Sequence; identical to SEQ ID NO: 3451
  Description of Artificial Sequence: Synthetic peptide
  n-term acetylation

SEQ ID NO: 3454 - protein, 38 aa, Artificial Sequence; identical to SEQ ID NO: 3451
  Description of Artificial Sequence: Synthetic peptide
  n-term acetylation
  c-term amidation

SEQ ID NO: 3455 - protein, 38 aa, Artificial Sequence; identical to SEQ ID NO: 608
  Description of Artificial Sequence: Synthetic peptide

SEQ ID NO: 3456 - protein, 38 aa, Artificial Sequence; identical to SEQ ID NO: 608
  Description of Artificial Sequence: Synthetic peptide
  c-term amidation

SEQ ID NO: 3457 - protein, 38 aa, Artificial Sequence; identical to SEQ ID NO: 608
  Description of Artificial Sequence: Synthetic peptide
  n-term acetylation

SEQ ID NO: 3458 - protein, 38 aa, Artificial Sequence; identical to SEQ ID NO: 608
  Description of Artificial Sequence: Synthetic peptide
  n-term acetylation
  c-term amidation

SEQ ID NO: 3459 - protein, 38 aa, Artificial Sequence; identical to SEQ ID NO: 2334
  Description of Artificial Sequence: Synthetic peptide

SEQ ID NO: 3460 - protein, 38 aa, Artificial Sequence; identical to SEQ ID NO: 2334
  Description of Artificial Sequence: Synthetic peptide
  n-term acetylation

SEQ ID NO: 3461 - protein, 38 aa, Artificial Sequence; identical to SEQ ID NO: 2334
  Description of Artificial Sequence: Synthetic peptide
  c-term amidation

SEQ ID NO: 3462 - protein, 38 aa, Artificial Sequence; identical to SEQ ID NO: 2334
  Description of Artificial Sequence: Synthetic peptide
  n-term acetylation
  c-term amidation

SEQ ID NO: 3463 - protein, 37 aa, Artificial Sequence
  Description of Artificial Sequence: Synthetic peptide
TIINVKCKISRQCLKPCKDAGMRFGACMNGKCHCTPK

SEQ ID NO: 3464 - protein, 37 aa, Artificial Sequence; identical to SEQ ID NO: 3463
  Description of Artificial Sequence: Synthetic peptide
  n-term acetylation

SEQ ID NO: 3465 - protein, 37 aa, Artificial Sequence; identical to SEQ ID NO: 3463
  Description of Artificial Sequence: Synthetic peptide
  c-term amidation

SEQ ID NO: 3466 - protein, 37 aa, Artificial Sequence; identical to SEQ ID NO: 3463
  Description of Artificial Sequence: Synthetic peptide
  n-term acetylation
  c-term amidation

SEQ ID NO: 3467 - protein, 38 aa, Artificial Sequence
  Description of Artificial Sequence: Synthetic peptide
GVKINVKCKISRQCLEPCKKAGMRFGACMNGKCHCTPK

SEQ ID NO: 3468 - protein, 38 aa, Artificial Sequence; identical to SEQ ID NO: 3467
  Description of Artificial Sequence: Synthetic peptide
  n-term acetylation

SEQ ID NO: 3469 - protein, 38 aa, Artificial Sequence; identical to SEQ ID NO: 3467
  Description of Artificial Sequence: Synthetic peptide
  c-term amidation

SEQ ID NO: 3470 - protein, 38 aa, Artificial Sequence; identical to SEQ ID NO: 3467
  Description of Artificial Sequence: Synthetic peptide
  n-term acetylation
  c-term amidation

SEQ ID NO: 3471 - protein, 38 aa, Artificial Sequence
  Description of Artificial Sequence: Synthetic peptide
GVKINVKCKISRQCLEPCKKAGMRFGACMNGKCACTPK

SEQ ID NO: 3472 - protein, 38 aa, Artificial Sequence
  Description of Artificial Sequence: Synthetic peptide
GVKINVKCKISRQCLKPCKDAGMRFGACMNGKCHCTPK

SEQ ID NO: 3473 - protein, 38 aa, Artificial Sequence
  Description of Artificial Sequence: Synthetic peptide
GVKINVKCKISRQCLKPCKDAGMRFGACMNGKCACTPK

SEQ ID NO: 3474 - protein, 38 aa, Artificial Sequence; identical to SEQ ID NO: 3471
  Description of Artificial Sequence: Synthetic peptide
  n-term acetylation

SEQ ID NO: 3475 - protein, 38 aa, Artificial Sequence; identical to SEQ ID NO: 3471
  Description of Artificial Sequence: Synthetic peptide
  c-term amidation

SEQ ID NO: 3476 - protein, 38 aa, Artificial Sequence; identical to SEQ ID NO: 3471
  Description of Artificial Sequence: Synthetic peptide
  n-term acetylation
  c-term amidation

SEQ ID NO: 3477 - protein, 38 aa, Artificial Sequence; identical to SEQ ID NO: 3473
  Description of Artificial Sequence: Synthetic peptide
  n-term acetylation

SEQ ID NO: 3478 - protein, 38 aa, Artificial Sequence; identical to SEQ ID NO: 3473
  Description of Artificial Sequence: Synthetic peptide
  c-term amidation

SEQ ID NO: 3479 - protein, 38 aa, Artificial Sequence; identical to SEQ ID NO: 3473
  Description of Artificial Sequence: Synthetic peptide
  n-term acetylation
  c-term amidation

SEQ ID NO: 3480 - protein, 38 aa, Artificial Sequence; identical to SEQ ID NO: 3472
  Description of Artificial Sequence: Synthetic peptide
  n-term acetylation

SEQ ID NO: 3481 - protein, 38 aa, Artificial Sequence; identical to SEQ ID NO: 3472
  Description of Artificial Sequence: Synthetic peptide
  c-term amidation

SEQ ID NO: 3482 - protein, 38 aa, Artificial Sequence; identical to SEQ ID NO: 3472
  Description of Artificial Sequence: Synthetic peptide
  n-term acetylation
  c-term amidation

SEQ ID NO: 3483 - protein, 36 aa, Artificial Sequence
  Description of Artificial Sequence: Synthetic peptide
GVIINVKCKISRQCLKPCKDAGMRFGACMNGKCHCT

SEQ ID NO: 3484 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCHCTPK

SEQ ID NO: 3485 - protein, 38 aa, Artificial Sequence; identical to SEQ ID NO: 3484
  Description of Artificial Sequence: Synthetic peptide
  MOD_RES (16)..(16): hLys

SEQ ID NO: 3486 - protein, 38 aa, Artificial Sequence; identical to SEQ ID NO: 3484
  Description of Artificial Sequence: Synthetic peptide
  MOD_RES (16)..(16): hArg

SEQ ID NO: 3487 - protein, 38 aa, Artificial Sequence; identical to SEQ ID NO: 3484
  Description of Artificial Sequence: Synthetic peptide
  MOD_RES (16)..(16): Cit

SEQ ID NO: 3488 - protein, 38 aa, Artificial Sequence; identical to SEQ ID NO: 3484
  Description of Artificial Sequence: Synthetic peptide
  MOD_RES (16)..(16): hCit

SEQ ID NO: 3489 - protein, 38 aa, Artificial Sequence; identical to SEQ ID NO: 3484
  Description of Artificial Sequence: Synthetic peptide
  MOD_RES (16)..(16): Dpr

SEQ ID NO: 3490 - protein, 38 aa, Artificial Sequence; identical to SEQ ID NO: 3484
  Description of Artificial Sequence: Synthetic peptide
  MOD_RES (16)..(16): Dab

SEQ ID NO: 3491 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCHCYPK

SEQ ID NO: 3492 - protein, 38 aa, Artificial Sequence; identical to SEQ ID NO: 3491
  Description of Artificial Sequence: Synthetic peptide
  MOD_RES (16)..(16): hLys

SEQ ID NO: 3493 - protein, 38 aa, Artificial Sequence; identical to SEQ ID NO: 3491
  Description of Artificial Sequence: Synthetic peptide
  MOD_RES (16)..(16): hArg

SEQ ID NO: 3494 - protein, 38 aa, Artificial Sequence; identical to SEQ ID NO: 3491
  Description of Artificial Sequence: Synthetic peptide
  MOD_RES (16)..(16): Cit

SEQ ID NO: 3495 - protein, 38 aa, Artificial Sequence; identical to SEQ ID NO: 3491
  Description of Artificial Sequence: Synthetic peptide
  MOD_RES (16)..(16): hCit

SEQ ID NO: 3496 - protein, 38 aa, Artificial Sequence; identical to SEQ ID NO: 3491
  Description of Artificial Sequence: Synthetic peptide
  MOD_RES (16)..(16): Dpr

SEQ ID NO: 3497 - protein, 38 aa, Artificial Sequence; identical to SEQ ID NO: 3491
  Description of Artificial Sequence: Synthetic peptide
  MOD_RES (16)..(16): Dab

SEQ ID NO: 3498 - protein, 38 aa, Artificial Sequence
  Description of Artificial Sequence: Synthetic peptide
GVIINVKCKISRQCLKPCKDAGMRFGACMNGKCACYPK

SEQ ID NO: 3499 - protein, 38 aa, Artificial Sequence
  Description of Artificial Sequence: Synthetic peptide
GVIINVKCKISRQCLKPCKDAGMRFGACMNGKCGCYPK

SEQ ID NO: 3500 - protein, 38 aa, Artificial Sequence
  Description of Artificial Sequence: Synthetic peptide
GVIINVKCKISRQCLKPCKDAGMRFGACMNGKCACFPK

SEQ ID NO: 3501 - protein, 38 aa, Artificial Sequence
  Description of Artificial Sequence: Synthetic peptide
GVIINVKCKISRQCLKPCKDAGMRFGACMNGKCACWPK

SEQ ID NO: 3502 - protein, 38 aa, Artificial Sequence
  Description of Artificial Sequence: Synthetic peptide
GVIINVKCKISRQCLKPCKEAGMRFGACMNGKCACYPK

SEQ ID NO: 3503 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCACTPK

SEQ ID NO: 3504 - protein, 38 aa, Artificial Sequence; identical to SEQ ID NO: 3503
  Description of Artificial Sequence: Synthetic peptide
  MOD_RES (16)..(16): hLys

SEQ ID NO: 3505 - protein, 38 aa, Artificial Sequence; identical to SEQ ID NO: 3503
  Description of Artificial Sequence: Synthetic peptide
  MOD_RES (16)..(16): hArg

SEQ ID NO: 3506 - protein, 38 aa, Artificial Sequence; identical to SEQ ID NO: 3503
  Description of Artificial Sequence: Synthetic peptide
  MOD_RES (16)..(16): Cit

SEQ ID NO: 3507 - protein, 38 aa, Artificial Sequence; identical to SEQ ID NO: 3484
  Description of Artificial Sequence: Synthetic peptide
  MOD_RES (16)..(16): hCit

SEQ ID NO: 3508 - protein, 38 aa, Artificial Sequence; identical to SEQ ID NO: 3503
  Description of Artificial Sequence: Synthetic peptide
  MOD_RES (16)..(16): Dpr

SEQ ID NO: 3509 - protein, 38 aa, Artificial Sequence; identical to SEQ ID NO: 3503
  Description of Artificial Sequence: Synthetic peptide
  MOD_RES (16)..(16): Dab

SEQ ID NO: 3510 - protein, 35 aa, Artificial Sequence
  Description of Artificial Sequence: Synthetic peptide
  MOD_RES (16)..(16): Orn
GVIINVKCKISRQCLXPCKDAGMRFGACMNGKCHC

SEQ ID NO: 3511 - protein, 35 aa, Artificial Sequence; identical to SEQ ID NO: 3510
  Description of Artificial Sequence: Synthetic peptide
  MOD_RES (16)..(16): hLys

SEQ ID NO: 3512 - protein, 35 aa, Artificial Sequence; identical to SEQ ID NO: 3510
  Description of Artificial Sequence: Synthetic peptide
  MOD_RES (16)..(16): hArg

SEQ ID NO: 3513 - protein, 35 aa, Artificial Sequence; identical to SEQ ID NO: 3510
  Description of Artificial Sequence: Synthetic peptide
  MOD_RES (16)..(16): Cit

SEQ ID NO: 3514 - protein, 35 aa, Artificial Sequence; identical to SEQ ID NO: 3510
  Description of Artificial Sequence: Synthetic peptide
  MOD_RES (16)..(16): hCit

SEQ ID NO: 3515 - protein, 35 aa, Artificial Sequence; identical to SEQ ID NO: 3510
  Description of Artificial Sequence: Synthetic peptide
  MOD_RES (16)..(16): Dpr

SEQ ID NO: 3516 - protein, 35 aa, Artificial Sequence; identical to SEQ ID NO: 3510
  Description of Artificial Sequence: Synthetic peptide
  MOD_RES (16)..(16): Dab

SEQ ID NO: 3517 - protein, 35 aa, Artificial Sequence
  Description of Artificial Sequence: Synthetic peptide
  MOD_RES (16)..(16): Orn
GVIINVKCKISRQCLXPCKDAGMRFGACMNGKCAC

SEQ ID NO: 3518 - protein, 35 aa, Artificial Sequence; identical to SEQ ID NO: 3517
  Description of Artificial Sequence: Synthetic peptide
  MOD_RES (16)..(16): hLys

SEQ ID NO: 3519 - protein, 35 aa, Artificial Sequence; identical to SEQ ID NO: 3517
  Description of Artificial Sequence: Synthetic peptide
  MOD_RES (16)..(16): hArg

SEQ ID NO: 3520 - protein, 35 aa, Artificial Sequence; identical to SEQ ID NO: 3517
  Description of Artificial Sequence: Synthetic peptide
  MOD_RES (16)..(16): Cit

SEQ ID NO: 3521 - protein, 35 aa, Artificial Sequence; identical to SEQ ID NO: 3510
  Description of Artificial Sequence: Synthetic peptide
  MOD_RES (16)..(16): hCit

SEQ ID NO: 3522 - protein, 35 aa, Artificial Sequence; identical to SEQ ID NO: 3517
  Description of Artificial Sequence: Synthetic peptide
  MOD_RES (16)..(16): Dpr

SEQ ID NO: 3523 - protein, 35 aa, Artificial Sequence; identical to SEQ ID NO: 3517
  Description of Artificial Sequence: Synthetic peptide
  MOD_RES (16)..(16): Dab

SEQ ID NO: 3524 - protein, 38 aa, Artificial Sequence
  Description of Artificial Sequence: Synthetic peptide
GVIINVKCKISRQCLKPCKDAGMRFGACMNGKCGCYGG

SEQ ID NO: 3525 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCHCYGG

SEQ ID NO: 3526 - protein, 38 aa, Artificial Sequence; identical to SEQ ID NO: 3525
  Description of Artificial Sequence: Synthetic peptide
  MOD_RES (16)..(16): hLys

SEQ ID NO: 3527 - protein, 38 aa, Artificial Sequence; identical to SEQ ID NO: 3525
  Description of Artificial Sequence: Synthetic peptide
  MOD_RES (16)..(16): hArg

SEQ ID NO: 3528 - protein, 38 aa, Artificial Sequence; identical to SEQ ID NO: 3525
  Description of Artificial Sequence: Synthetic peptide
  MOD_RES (16)..(16): Cit

SEQ ID NO: 3529 - protein, 38 aa, Artificial Sequence; identical to SEQ ID NO: 3525
  Description of Artificial Sequence: Synthetic peptide
  MOD_RES (16)..(16): hCit

SEQ ID NO: 3530 - protein, 38 aa, Artificial Sequence; identical to SEQ ID NO: 3525
  Description of Artificial Sequence: Synthetic peptide
  MOD_RES (16)..(16): Dpr

SEQ ID NO: 3531 - protein, 38 aa, Artificial Sequence
  Description of Artificial Sequence: Synthetic peptide
GVIINVKCKISRQCLKPCKDAGMRFGACMNGKCACYGG

SEQ ID NO: 3532 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCACYGG

SEQ ID NO: 3533 - protein, 38 aa, Artificial Sequence; identical to SEQ ID NO: 3532
  Description of Artificial Sequence: Synthetic peptide
  MOD_RES (16)..(16): hLys

SEQ ID NO: 3534 - protein, 38 aa, Artificial Sequence; identical to SEQ ID NO: 3532
  Description of Artificial Sequence: Synthetic peptide
  MOD_RES (16)..(16): hArg

SEQ ID NO: 3535 - protein, 38 aa, Artificial Sequence; identical to SEQ ID NO: 3532
  Description of Artificial Sequence: Synthetic peptide
  MOD_RES (16)..(16): Cit

SEQ ID NO: 3536 - protein, 38 aa, Artificial Sequence; identical to SEQ ID NO: 3525
  Description of Artificial Sequence: Synthetic peptide
  MOD_RES (16)..(16): hCit

SEQ ID NO: 3537 - protein, 38 aa, Artificial Sequence; identical to SEQ ID NO: 3532
  Description of Artificial Sequence: Synthetic peptide
  MOD_RES (16)..(16): Dpr

SEQ ID NO: 3538 - protein, 38 aa, Artificial Sequence; identical to SEQ ID NO: 3532
  Description of Artificial Sequence: Synthetic peptide
  MOD_RES (16)..(16): Dab

SEQ ID NO: 3539 - protein, 37 aa, Artificial Sequence
  Description of Artificial Sequence: Synthetic peptide
GVIINVKCKISRQCLKPCKDAGMRFGACMNGKCACYG

SEQ ID NO: 3540 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCHCGGG

SEQ ID NO: 3541 - protein, 38 aa, Artificial Sequence; identical to SEQ ID NO: 3540
  Description of Artificial Sequence: Synthetic peptide
  MOD_RES (16)..(16): hLys

SEQ ID NO: 3542 - protein, 38 aa, Artificial Sequence; identical to SEQ ID NO: 3540
  Description of Artificial Sequence: Synthetic peptide
  MOD_RES (16)..(16): hArg

SEQ ID NO: 3543 - protein, 38 aa, Artificial Sequence; identical to SEQ ID NO: 3540
  Description of Artificial Sequence: Synthetic peptide
  MOD_RES (16)..(16): Cit

SEQ ID NO: 3544 - protein, 38 aa, Artificial Sequence; identical to SEQ ID NO: 3540
  Description of Artificial Sequence: Synthetic peptide
  MOD_RES (16)..(16): hCit

SEQ ID NO: 3545 - protein, 38 aa, Artificial Sequence; identical to SEQ ID NO: 3540
  Description of Artificial Sequence: Synthetic peptide
  MOD_RES (16)..(16): Dpr

SEQ ID NO: 3546 - protein, 38 aa, Artificial Sequence
  Description of Artificial Sequence: Synthetic peptide
GVIINVKCKISRQCLKPCKDAGMRFGACMNGKCACFGG

SEQ ID NO: 3547 - protein, 38 aa, Artificial Sequence
  Description of Artificial Sequence: Synthetic peptide
  MOD_RES (16)..(16): Orn
GVIINVKCKISRQCLXPCKDAGMRFGACMNGKCACGGG

SEQ ID NO: 3548 - protein, 38 aa, Artificial Sequence; identical to SEQ ID NO: 3547
  Description of Artificial Sequence: Synthetic peptide
  MOD_RES (16)..(16): hLys

SEQ ID NO: 3549 - protein, 38 aa, Artificial Sequence; identical to SEQ ID NO: 3547
  Description of Artificial Sequence: Synthetic peptide
  MOD_RES (16)..(16): hArg

SEQ ID NO: 3550 - protein, 38 aa, Artificial Sequence; identical to SEQ ID NO: 3547
  Description of Artificial Sequence: Synthetic peptide
  MOD_RES (16)..(16): Cit

SEQ ID NO: 3551 - protein, 38 aa, Artificial Sequence; identical to SEQ ID NO: 3547
  Description of Artificial Sequence: Synthetic peptide
  MOD_RES (16)..(16): hCit

SEQ ID NO: 3552 - protein, 38 aa, Artificial Sequence; identical to SEQ ID NO: 3547
  Description of Artificial Sequence: Synthetic peptide
  MOD_RES (16)..(16): Dpr

SEQ ID NO: 3553 - protein, 38 aa, Artificial Sequence; identical to SEQ ID NO: 3547
  Description of Artificial Sequence: Synthetic peptide
  MOD_RES (16)..(16): Dab

SEQ ID NO: 3554 - protein, 37 aa, Artificial Sequence
  Description of Artificial Sequence: Synthetic peptide
GVIINVKCKISRQCLKPCKDAGMRFGACMNGKCACGG

SEQ ID NO: 3555 - protein, 37 aa, Artificial Sequence; identical to SEQ ID NO: 3539
  Description of Artificial Sequence: Synthetic peptide

SEQ ID NO: 3556 - protein, 37 aa, Artificial Sequence
  Description of Artificial Sequence: Synthetic peptide
  MOD_RES (16)..(16): Orn
GVIINVKCKISRQCLXPCKDAGMRFGACMNGKCACGG

SEQ ID NO: 3557 - protein, 38 aa, Artificial Sequence
  Description of Artificial Sequence: Synthetic peptide
  MOD_RES (16)..(16): hLys
GVIINVKCKISRQCLXPCKEAGMRFGACMNGKCHCTPK

SEQ ID NO: 3558 - protein, 38 aa, Artificial Sequence; identical to SEQ ID NO: 3557
  Description of Artificial Sequence: Synthetic peptide
  MOD_RES (16)..(16): hArg

SEQ ID NO: 3559 - protein, 38 aa, Artificial Sequence; identical to SEQ ID NO: 3557
  Description of Artificial Sequence: Synthetic peptide
  MOD_RES (16)..(16): Cit

SEQ ID NO: 3560 - protein, 38 aa, Artificial Sequence; identical to SEQ ID NO: 3557
  Description of Artificial Sequence: Synthetic peptide
  MOD_RES (16)..(16): hCit

SEQ ID NO: 3561 - protein, 38 aa, Artificial Sequence; identical to SEQ ID NO: 3557
  Description of Artificial Sequence: Synthetic peptide
  MOD_RES (16)..(16): Dpr

SEQ ID NO: 3562 - protein, 38 aa, Artificial Sequence; identical to SEQ ID NO: 3557
  Description of Artificial Sequence: Synthetic peptide
  MOD_RES (16)..(16): Dab

SEQ ID NO: 3563 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCHCYPK

SEQ ID NO: 3564 - protein, 38 aa, Artificial Sequence; identical to SEQ ID NO: 3563
  Description of Artificial Sequence: Synthetic peptide
  MOD_RES (16)..(16): hLys

SEQ ID NO: 3565 - protein, 38 aa, Artificial Sequence; identical to SEQ ID NO: 3563
  Description of Artificial Sequence: Synthetic peptide
  MOD_RES (16)..(16): hArg

SEQ ID NO: 3566 - protein, 38 aa, Artificial Sequence; identical to SEQ ID NO: 3563
  Description of Artificial Sequence: Synthetic peptide
  MOD_RES (16)..(16): Cit

SEQ ID NO: 3567 - protein, 38 aa, Artificial Sequence; identical to SEQ ID NO: 3563
  Description of Artificial Sequence: Synthetic peptide
  MOD_RES (16)..(16): hCit

SEQ ID NO: 3568 - protein, 38 aa, Artificial Sequence; identical to SEQ ID NO: 3563
  Description of Artificial Sequence: Synthetic peptide
  MOD_RES (16)..(16): Dpr

SEQ ID NO: 3569 - protein, 38 aa, Artificial Sequence; identical to SEQ ID NO: 3563
  Description of Artificial Sequence: Synthetic peptide
  MOD_RES (16)..(16): Dab

SEQ ID NO: 3570 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCACTPK

SEQ ID NO: 3571 - protein, 38 aa, Artificial Sequence; identical to SEQ ID NO: 3570
  Description of Artificial Sequence: Synthetic peptide
  MOD_RES (16)..(16): hLys

SEQ ID NO: 3572 - protein, 38 aa, Artificial Sequence; identical to SEQ ID NO: 3570
  Description of Artificial Sequence: Synthetic peptide
  MOD_RES (16)..(16): hArg

SEQ ID NO: 3573 - protein, 38 aa, Artificial Sequence; identical to SEQ ID NO: 3570
  Description of Artificial Sequence: Synthetic peptide
  MOD_RES (16)..(16): Cit

SEQ ID NO: 3574 - protein, 38 aa, Artificial Sequence; identical to SEQ ID NO: 3557
  Description of Artificial Sequence: Synthetic peptide
  MOD_RES (16)..(16): hCit

SEQ ID NO: 3575 - protein, 38 aa, Artificial Sequence; identical to SEQ ID NO: 3570
  Description of Artificial Sequence: Synthetic peptide
  MOD_RES (16)..(16): Dpr

SEQ ID NO: 3576 - protein, 38 aa, Artificial Sequence; identical to SEQ ID NO: 3570
  Description of Artificial Sequence: Synthetic peptide
  MOD_RES (16)..(16): Dab

SEQ ID NO: 3577 - protein, 35 aa, Artificial Sequence
  Description of Artificial Sequence: Synthetic peptide
  MOD_RES (16)..(16): Orn
GVIINVKCKISRQCLXPCKEAGMRFGACMNGKCHC

SEQ ID NO: 3578 - protein, 35 aa, Artificial Sequence; identical to SEQ ID NO: 3577
  Description of Artificial Sequence: Synthetic peptide
  MOD_RES (16)..(16): hLys

SEQ ID NO: 3579 - protein, 35 aa, Artificial Sequence; identical to SEQ ID NO: 3577
  Description of Artificial Sequence: Synthetic peptide
  MOD_RES (16)..(16): hArg

SEQ ID NO: 3580 - protein, 35 aa, Artificial Sequence; identical to SEQ ID NO: 3577
  Description of Artificial Sequence: Synthetic peptide
  MOD_RES (16)..(16): Cit

SEQ ID NO: 3581 - protein, 35 aa, Artificial Sequence; identical to SEQ ID NO: 3577
  Description of Artificial Sequence: Synthetic peptide
  MOD_RES (16)..(16): hCit

SEQ ID NO: 3582 - protein, 35 aa, Artificial Sequence; identical to SEQ ID NO: 3577
  Description of Artificial Sequence: Synthetic peptide
  MOD_RES (16)..(16): Dpr

SEQ ID NO: 3583 - protein, 35 aa, Artificial Sequence
  Description of Artificial Sequence: Synthetic peptide
  MOD_RES (16)..(16): Orn
GVIINVKCKISRQCLXPCKEAGMRFGACMNGKCAC

SEQ ID NO: 3584 - protein, 35 aa, Artificial Sequence; identical to SEQ ID NO: 3583
  Description of Artificial Sequence: Synthetic peptide
  MOD_RES (16)..(16): hLys

SEQ ID NO: 3585 - protein, 35 aa, Artificial Sequence; identical to SEQ ID NO: 3583
  Description of Artificial Sequence: Synthetic peptide
  MOD_RES (16)..(16): hArg

SEQ ID NO: 3586 - protein, 35 aa, Artificial Sequence; identical to SEQ ID NO: 3583
  Description of Artificial Sequence: Synthetic peptide
  MOD_RES (16)..(16): Cit

SEQ ID NO: 3587 - protein, 35 aa, Artificial Sequence; identical to SEQ ID NO: 3577
  Description of Artificial Sequence: Synthetic peptide
  MOD_RES (16)..(16): hCit

SEQ ID NO: 3588 - protein, 35 aa, Artificial Sequence; identical to SEQ ID NO: 3583
  Description of Artificial Sequence: Synthetic peptide
  MOD_RES (16)..(16): Dpr

SEQ ID NO: 3589 - protein, 35 aa, Artificial Sequence; identical to SEQ ID NO: 3583
  Description of Artificial Sequence: Synthetic peptide
  MOD_RES (16)..(16): Dab

SEQ ID NO: 3590 - protein, 38 aa, Artificial Sequence
  Description of Artificial Sequence: Synthetic peptide
GVIINVKCKISRQCLKPCKEAGMRFGACMNGKCHCYGG

SEQ ID NO: 3591 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCHCYGG

SEQ ID NO: 3592 - protein, 37 aa, Artificial Sequence
  Description of Artificial Sequence: Synthetic peptide
GVIINVKCKISRQCLKPCKEAGMRFGACMNGKCHCYG

SEQ ID NO: 3593 - protein, 37 aa, Artificial Sequence
  Description of Artificial Sequence: Synthetic peptide
GVIINVKCKISRQCLKPCKEAGMRFGACMNGKCACYG

SEQ ID NO: 3594 - protein, 38 aa, Artificial Sequence; identical to SEQ ID NO: 3591
  Description of Artificial Sequence: Synthetic peptide
  MOD_RES (16)..(16): hLys

SEQ ID NO: 3595 - protein, 38 aa, Artificial Sequence; identical to SEQ ID NO: 3591
  Description of Artificial Sequence: Synthetic peptide
  MOD_RES (16)..(16): hArg

SEQ ID NO: 3596 - protein, 38 aa, Artificial Sequence; identical to SEQ ID NO: 3591
  Description of Artificial Sequence: Synthetic peptide
  MOD_RES (16)..(16): Cit

SEQ ID NO: 3597 - protein, 38 aa, Artificial Sequence; identical to SEQ ID NO: 3591
  Description of Artificial Sequence: Synthetic peptide
  MOD_RES (16)..(16): hCit

SEQ ID NO: 3598 - protein, 38 aa, Artificial Sequence; identical to SEQ ID NO: 3591
  Description of Artificial Sequence: Synthetic peptide
  MOD_RES (16)..(16): Dpr

SEQ ID NO: 3599 - protein, 38 aa, Artificial Sequence; identical to SEQ ID NO: 3591
  Description of Artificial Sequence: Synthetic peptide
  MOD_RES (16)..(16): Dab

SEQ ID NO: 3600 - protein, 37 aa, Artificial Sequence; identical to SEQ ID NO: 3593
  Description of Artificial Sequence: Synthetic peptide

SEQ ID NO: 3601 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCACYGG

SEQ ID NO: 3602 - protein, 38 aa, Artificial Sequence; identical to SEQ ID NO: 3601
  Description of Artificial Sequence: Synthetic peptide
  MOD_RES (16)..(16): hLys

SEQ ID NO: 3603 - protein, 38 aa, Artificial Sequence; identical to SEQ ID NO: 3601
  Description of Artificial Sequence: Synthetic peptide
  MOD_RES (16)..(16): hArg

SEQ ID NO: 3604 - protein, 38 aa, Artificial Sequence; identical to SEQ ID NO: 3601
  Description of Artificial Sequence: Synthetic peptide
  MOD_RES (16)..(16): Cit

SEQ ID NO: 3605 - protein, 38 aa, Artificial Sequence; identical to SEQ ID NO: 3591
  Description of Artificial Sequence: Synthetic peptide
  MOD_RES (16)..(16): hCit

SEQ ID NO: 3606 - protein, 38 aa, Artificial Sequence; identical to SEQ ID NO: 3601
  Description of Artificial Sequence: Synthetic peptide
  MOD_RES (16)..(16): Dpr

SEQ ID NO: 3607 - protein, 38 aa, Artificial Sequence; identical to SEQ ID NO: 3601
  Description of Artificial Sequence: Synthetic peptide
  MOD_RES (16)..(16): Dab

SEQ ID NO: 3608 - protein, 38 aa, Artificial Sequence
  Description of Artificial Sequence: Synthetic peptide
GVIINVKCKISRQCLKPCKEAGMRFGACMNGKCACFGG

SEQ ID NO: 3609 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCHCGGG

SEQ ID NO: 3610 - protein, 38 aa, Artificial Sequence; identical to SEQ ID NO: 3609
  Description of Artificial Sequence: Synthetic peptide
  MOD_RES (16)..(16): hLys

SEQ ID NO: 3611 - protein, 38 aa, Artificial Sequence; identical to SEQ ID NO: 3609
  Description of Artificial Sequence: Synthetic peptide
  MOD_RES (16)..(16): hArg

SEQ ID NO: 3612 - protein, 38 aa, Artificial Sequence; identical to SEQ ID NO: 3609
  Description of Artificial Sequence: Synthetic peptide
  MOD_RES (16)..(16): Cit

SEQ ID NO: 3613 - protein, 38 aa, Artificial Sequence; identical to SEQ ID NO: 3609
  Description of Artificial Sequence: Synthetic peptide
  MOD_RES (16)..(16): hCit

SEQ ID NO: 3614 - protein, 38 aa, Artificial Sequence; identical to SEQ ID NO: 3609
  Description of Artificial Sequence: Synthetic peptide
  MOD_RES (16)..(16): Dpr

SEQ ID NO: 3615 - protein, 38 aa, Artificial Sequence
  Description of Artificial Sequence: Synthetic peptide
  MOD_RES (16)..(16): Orn
GVIINVKCKISRQCLXPCKEAGMRFGACMNGKCACGGG

SEQ ID NO: 3616 - protein, 38 aa, Artificial Sequence; identical to SEQ ID NO: 3615
  Description of Artificial Sequence: Synthetic peptide
  MOD_RES (16)..(16): hLys

SEQ ID NO: 3617 - protein, 38 aa, Artificial Sequence; identical to SEQ ID NO: 3615
  Description of Artificial Sequence: Synthetic peptide
  MOD_RES (16)..(16): hArg

SEQ ID NO: 3618 - protein, 38 aa, Artificial Sequence; identical to SEQ ID NO: 3615
  Description of Artificial Sequence: Synthetic peptide
  MOD_RES (16)..(16): Cit

SEQ ID NO: 3619 - protein, 37 aa, Artificial Sequence
  Description of Artificial Sequence: Synthetic peptide
  MOD_RES (16)..(16): hCit
GVIINVKCKISRQCLXPCKEAGMRFGACMNGKCACTP

SEQ ID NO: 3620 - protein, 37 aa, Artificial Sequence; identical to SEQ ID NO: 3619
  Description of Artificial Sequence: Synthetic peptide
  MOD_RES (16)..(16): Dpr

SEQ ID NO: 3621 - protein, 37 aa, Artificial Sequence; identical to SEQ ID NO: 3619
  Description of Artificial Sequence: Synthetic peptide
  MOD_RES (16)..(16): Dab

SEQ ID NO: 3622 - protein, 38 aa, Artificial Sequence; identical to SEQ ID NO: 3484
  Description of Artificial Sequence: Synthetic peptide
  MOD_RES (16)..(16): Orn
  c-term amidation

SEQ ID NO: 3623 - protein, 38 aa, Artificial Sequence; identical to SEQ ID NO: 3484
  Description of Artificial Sequence: Synthetic peptide
  MOD_RES (16)..(16): hLys
  c-term amidation

SEQ ID NO: 3624 - protein, 38 aa, Artificial Sequence; identical to SEQ ID NO: 3484
  Description of Artificial Sequence: Synthetic peptide
  MOD_RES (16)..(16): hArg
  c-term amidation

SEQ ID NO: 3625 - protein, 38 aa, Artificial Sequence; identical to SEQ ID NO: 3484
  Description of Artificial Sequence: Synthetic peptide
  MOD_RES (16)..(16): Cit
  c-term amidation

SEQ ID NO: 3626 - protein, 38 aa, Artificial Sequence; identical to SEQ ID NO: 3484
  Description of Artificial Sequence: Synthetic peptide
  MOD_RES (16)..(16): hCit
  c-term amidation

SEQ ID NO: 3627 - protein, 38 aa, Artificial Sequence; identical to SEQ ID NO: 3484
  Description of Artificial Sequence: Synthetic peptide
  MOD_RES (16)..(16): Dpr
  c-term amidation

SEQ ID NO: 3628 - protein, 38 aa, Artificial Sequence; identical to SEQ ID NO: 3484
  Description of Artificial Sequence: Synthetic peptide
  MOD_RES (16)..(16): Dab
  c-term amidation

SEQ ID NO: 3629 - protein, 38 aa, Artificial Sequence; identical to SEQ ID NO: 3491
  Description of Artificial Sequence: Synthetic peptide
  MOD_RES (16)..(16): Orn
  c-term amidation

SEQ ID NO: 3630 - protein, 38 aa, Artificial Sequence; identical to SEQ ID NO: 3491
  Description of Artificial Sequence: Synthetic peptide
  MOD_RES (16)..(16): hLys
  c-term amidation

SEQ ID NO: 3631 - protein, 38 aa, Artificial Sequence; identical to SEQ ID NO: 3491
  Description of Artificial Sequence: Synthetic peptide
  MOD_RES (16)..(16): hArg
  c-term amidation

SEQ ID NO: 3632 - protein, 38 aa, Artificial Sequence; identical to SEQ ID NO: 3491
  Description of Artificial Sequence: Synthetic peptide
  MOD_RES (16)..(16): Cit
  c-term amidation

SEQ ID NO: 3633 - protein, 38 aa, Artificial Sequence; identical to SEQ ID NO: 3491
  Description of Artificial Sequence: Synthetic peptide
  MOD_RES (16)..(16): hCit
  c-term amidation

SEQ ID NO: 3634 - protein, 38 aa, Artificial Sequence; identical to SEQ ID NO: 3491
  Description of Artificial Sequence: Synthetic peptide
  MOD_RES (16)..(16): Dpr
  c-term amidation

SEQ ID NO: 3635 - protein, 38 aa, Artificial Sequence; identical to SEQ ID NO: 3491
  Description of Artificial Sequence: Synthetic peptide
  MOD_RES (16)..(16): Dab
  c-term amidation

SEQ ID NO: 3636 - protein, 38 aa, Artificial Sequence; identical to SEQ ID NO: 3503
  Description of Artificial Sequence: Synthetic peptide
  MOD_RES (16)..(16): Orn
  c-term amidation

SEQ ID NO: 3637 - protein, 38 aa, Artificial Sequence; identical to SEQ ID NO: 3503
  Description of Artificial Sequence: Synthetic peptide
  MOD_RES (16)..(16): hLys
  c-term amidation

SEQ ID NO: 3638 - protein, 38 aa, Artificial Sequence; identical to SEQ ID NO: 3503
  Description of Artificial Sequence: Synthetic peptide
  MOD_RES (16)..(16): hArg
  c-term amidation

SEQ ID NO: 3639 - protein, 38 aa, Artificial Sequence; identical to SEQ ID NO: 3503
  Description of Artificial Sequence: Synthetic peptide
  MOD_RES (16)..(16): Cit
  c-term amidation

SEQ ID NO: 3640 - protein, 38 aa, Artificial Sequence; identical to SEQ ID NO: 3503
  Description of Artificial Sequence: Synthetic peptide
  MOD_RES (16)..(16): hCit
  c-term amidation

SEQ ID NO: 3641 - protein, 38 aa, Artificial Sequence; identical to SEQ ID NO: 3503
  Description of Artificial Sequence: Synthetic peptide
  MOD_RES (16)..(16): Dpr
  c-term amidation

SEQ ID NO: 3642 - protein, 38 aa, Artificial Sequence; identical to SEQ ID NO: 3503
  Description of Artificial Sequence: Synthetic peptide
  MOD_RES (16)..(16): Dab
  c-term amidation

SEQ ID NO: 3643 - protein, 35 aa, Artificial Sequence; identical to SEQ ID NO: 3510
  Description of Artificial Sequence: Synthetic peptide
  MOD_RES (16)..(16): Orn
  c-term amidation

SEQ ID NO: 3644 - protein, 35 aa, Artificial Sequence; identical to SEQ ID NO: 3510
  Description of Artificial Sequence: Synthetic peptide
  MOD_RES (16)..(16): hLys
  c-term amidation

SEQ ID NO: 3645 - protein, 35 aa, Artificial Sequence; identical to SEQ ID NO: 3510
  Description of Artificial Sequence: Synthetic peptide
  MOD_RES (16)..(16): hArg
  c-term amidation

SEQ ID NO: 3646 - protein, 35 aa, Artificial Sequence; identical to SEQ ID NO: 3510
  Description of Artificial Sequence: Synthetic peptide
  MOD_RES (16)..(16): Cit
  c-term amidation

SEQ ID NO: 3647 - protein, 35 aa, Artificial Sequence; identical to SEQ ID NO: 3510
  Description of Artificial Sequence: Synthetic peptide
  MOD_RES (16)..(16): hCit
  c-term amidation

SEQ ID NO: 3648 - protein, 35 aa, Artificial Sequence; identical to SEQ ID NO: 3510
  Description of Artificial Sequence: Synthetic peptide
  MOD_RES (16)..(16): Dpr
  c-term amidation

SEQ ID NO: 3649 - protein, 33 aa, Artificial Sequence
  Description of Artificial Sequence: Synthetic peptide
  MOD_RES (16)..(16): Orn
  c-term amidation
GVIINVKCKISRQCLXPCKDAGMRFGACMNGKC

SEQ ID NO: 3650 - protein, 33 aa, Artificial Sequence; identical to SEQ ID NO: 3649
  Description of Artificial Sequence: Synthetic peptide
  MOD_RES (16)..(16): hLys
  c-term amidation

SEQ ID NO: 3651 - protein, 33 aa, Artificial Sequence; identical to SEQ ID NO: 3649
  Description of Artificial Sequence: Synthetic peptide
  MOD_RES (16)..(16): hArg
  c-term amidation

SEQ ID NO: 3652 - protein, 33 aa, Artificial Sequence; identical to SEQ ID NO: 3649
  Description of Artificial Sequence: Synthetic peptide
  MOD_RES (16)..(16): Cit
  c-term amidation

SEQ ID NO: 3653 - protein, 35 aa, Artificial Sequence; identical to SEQ ID NO: 3510
  Description of Artificial Sequence: Synthetic peptide
  MOD_RES (16)..(16): hCit
  c-term amidation

SEQ ID NO: 3654 - protein, 33 aa, Artificial Sequence; identical to SEQ ID NO: 3649
  Description of Artificial Sequence: Synthetic peptide
  MOD_RES (16)..(16): Dpr
  c-term amidation

SEQ ID NO: 3655 - protein, 33 aa, Artificial Sequence; identical to SEQ ID NO: 3649
  Description of Artificial Sequence: Synthetic peptide
  MOD_RES (16)..(16): Dab
  c-term amidation

SEQ ID NO: 3656 - protein, 38 aa, Artificial Sequence
  Description of Artificial Sequence: Synthetic peptide
  c-term amidation
GVIINVKCKISRQCLKPCKDAGMRFGACMNGKCHCYGG

SEQ ID NO: 3657 - protein, 38 aa, Artificial Sequence; identical to SEQ ID NO: 3525
  Description of Artificial Sequence: Synthetic peptide
  MOD_RES (16)..(16): Orn
  c-term amidation

SEQ ID NO: 3658 - protein, 38 aa, Artificial Sequence; identical to SEQ ID NO: 3525
  Description of Artificial Sequence: Synthetic peptide
  MOD_RES (16)..(16): hLys
  c-term amidation

SEQ ID NO: 3659 - protein, 38 aa, Artificial Sequence; identical to SEQ ID NO: 3525
  Description of Artificial Sequence: Synthetic peptide
  MOD_RES (16)..(16): hArg
  c-term amidation

SEQ ID NO: 3660 - protein, 38 aa, Artificial Sequence; identical to SEQ ID NO: 3525
  Description of Artificial Sequence: Synthetic peptide
  MOD_RES (16)..(16): Cit
  c-term amidation

SEQ ID NO: 3661 - protein, 38 aa, Artificial Sequence; identical to SEQ ID NO: 3525
  Description of Artificial Sequence: Synthetic peptide
  MOD_RES (16)..(16): hCit
  c-term amidation

SEQ ID NO: 3662 - protein, 38 aa, Artificial Sequence; identical to SEQ ID NO: 3525
  Description of Artificial Sequence: Synthetic peptide
  MOD_RES (16)..(16): Dpr
  c-term amidation

SEQ ID NO: 3663 - protein, 38 aa, Artificial Sequence
  Description of Artificial Sequence: Synthetic peptide
  c-term amidation
GVIINVKCKISRQCLKPCKDAGMRFGACMNGKCHCFGG

SEQ ID NO: 3664 - protein, 37 aa, Artificial Sequence
  Description of Artificial Sequence: Synthetic peptide
  c-term amidation
GVIINVKCKISRQCLKPCKDAGMRFGACMNGKCHCYG

SEQ ID NO: 3665 - protein, 37 aa, Artificial Sequence; identical to SEQ ID NO: 3539
  Description of Artificial Sequence: Synthetic peptide
  c-term amidation

SEQ ID NO: 3666 - protein, 38 aa, Artificial Sequence; identical to SEQ ID NO: 3532
  Description of Artificial Sequence: Synthetic peptide
  MOD_RES (16)..(16): Orn
  c-term amidation

SEQ ID NO: 3667 - protein, 38 aa, Artificial Sequence; identical to SEQ ID NO: 3532
  Description of Artificial Sequence: Synthetic peptide
  MOD_RES (16)..(16): hLys
  c-term amidation

SEQ ID NO: 3668 - protein, 38 aa, Artificial Sequence; identical to SEQ ID NO: 3532
  Description of Artificial Sequence: Synthetic peptide
  MOD_RES (16)..(16): hArg
  c-term amidation

SEQ ID NO: 3669 - protein, 38 aa, Artificial Sequence; identical to SEQ ID NO: 3532
  Description of Artificial Sequence: Synthetic peptide
  MOD_RES (16)..(16): Cit
  c-term amidation

SEQ ID NO: 3670 - protein, 38 aa, Artificial Sequence; identical to SEQ ID NO: 3532
  Description of Artificial Sequence: Synthetic peptide
  MOD_RES (16)..(16): hCit
  c-term amidation

SEQ ID NO: 3671 - protein, 38 aa, Artificial Sequence; identical to SEQ ID NO: 3532
  Description of Artificial Sequence: Synthetic peptide
  MOD_RES (16)..(16): Dpr
  c-term amidation

SEQ ID NO: 3672 - protein, 38 aa, Artificial Sequence; identical to SEQ ID NO: 3532
  Description of Artificial Sequence: Synthetic peptide
  MOD_RES (16)..(16): Dab
  c-term amidation

SEQ ID NO: 3673 - protein, 38 aa, Artificial Sequence; identical to SEQ ID NO: 3531
  Description of Artificial Sequence: Synthetic peptide
  c-term amidation

SEQ ID NO: 3674 - protein, 38 aa, Artificial Sequence; identical to SEQ ID NO: 3540
  Description of Artificial Sequence: Synthetic peptide
  MOD_RES (16)..(16): Orn
  c-term amidation

SEQ ID NO: 3675 - protein, 38 aa, Artificial Sequence; identical to SEQ ID NO: 3540
  Description of Artificial Sequence: Synthetic peptide
  MOD_RES (16)..(16): hLys
  c-term amidation

SEQ ID NO: 3676 - protein, 38 aa, Artificial Sequence; identical to SEQ ID NO: 3540
  Description of Artificial Sequence: Synthetic peptide
  MOD_RES (16)..(16): hArg
  c-term amidation

SEQ ID NO: 3677 - protein, 38 aa, Artificial Sequence; identical to SEQ ID NO: 3540
  Description of Artificial Sequence: Synthetic peptide
  MOD_RES (16)..(16): Cit
  c-term amidation

SEQ ID NO: 3678 - protein, 38 aa, Artificial Sequence; identical to SEQ ID NO: 3540
  Description of Artificial Sequence: Synthetic peptide
  MOD_RES (16)..(16): hCit
  c-term amidation

SEQ ID NO: 3679 - protein, 38 aa, Artificial Sequence; identical to SEQ ID NO: 3540
  Description of Artificial Sequence: Synthetic peptide
  MOD_RES (16)..(16): Dpr
  c-term amidation

SEQ ID NO: 3680 - protein, 38 aa, Artificial Sequence
  Description of Artificial Sequence: Synthetic peptide
  c-term amidation
GVIINVKCKISRQCLKPCKDAGMRFGACMNGKCACGGG

SEQ ID NO: 3681 - protein, 38 aa, Artificial Sequence
  Description of Artificial Sequence: Synthetic peptide
  MOD_RES (16)..(16): Orn
  c-term amidation
GVIINVKCKISRQCLXPCKDAGMRFGACMNGKCACFGG

SEQ ID NO: 3682 - protein, 38 aa, Artificial Sequence; identical to SEQ ID NO: 3547
  Description of Artificial Sequence: Synthetic peptide
  MOD_RES (16)..(16): Orn
  c-term amidation

SEQ ID NO: 3683 - protein, 38 aa, Artificial Sequence; identical to SEQ ID NO: 3547
  Description of Artificial Sequence: Synthetic peptide
  MOD_RES (16)..(16): hLys
  c-term amidation

SEQ ID NO: 3684 - protein, 38 aa, Artificial Sequence; identical to SEQ ID NO: 3547
  Description of Artificial Sequence: Synthetic peptide
  MOD_RES (16)..(16): hArg
  c-term amidation

SEQ ID NO: 3685 - protein, 38 aa, Artificial Sequence; identical to SEQ ID NO: 3547
  Description of Artificial Sequence: Synthetic peptide
  MOD_RES (16)..(16): Cit
  c-term amidation

SEQ ID NO: 3686 - protein, 38 aa, Artificial Sequence; identical to SEQ ID NO: 3547
  Description of Artificial Sequence: Synthetic peptide
  MOD_RES (16)..(16): hCit
  c-term amidation

SEQ ID NO: 3687 - protein, 38 aa, Artificial Sequence; identical to SEQ ID NO: 3547
  Description of Artificial Sequence: Synthetic peptide
  MOD_RES (16)..(16): Dpr
  c-term amidation

SEQ ID NO: 3688 - protein, 38 aa, Artificial Sequence; identical to SEQ ID NO: 3547
  Description of Artificial Sequence: Synthetic peptide
  MOD_RES (16)..(16): Dab
  c-term amidation

SEQ ID NO: 3689 - protein, 38 aa, Artificial Sequence; identical to SEQ ID NO: 3557
  Description of Artificial Sequence: Synthetic peptide
  MOD_RES (16)..(16): Orn
  c-term amidation

SEQ ID NO: 3690 - protein, 38 aa, Artificial Sequence; identical to SEQ ID NO: 3557
  Description of Artificial Sequence: Synthetic peptide
  MOD_RES (16)..(16): hLys
  c-term amidation

SEQ ID NO: 3691 - protein, 38 aa, Artificial Sequence; identical to SEQ ID NO: 3557
  Description of Artificial Sequence: Synthetic peptide
  MOD_RES (16)..(16): hArg
  c-term amidation

SEQ ID NO: 3692 - protein, 38 aa, Artificial Sequence; identical to SEQ ID NO: 3557
  Description of Artificial Sequence: Synthetic peptide
  MOD_RES (16)..(16): Cit
  c-term amidation

SEQ ID NO: 3693 - protein, 38 aa, Artificial Sequence; identical to SEQ ID NO: 3557
  Description of Artificial Sequence: Synthetic peptide
  MOD_RES (16)..(16): hCit
  c-term amidation

SEQ ID NO: 3694 - protein, 38 aa, Artificial Sequence; identical to SEQ ID NO: 3557
  Description of Artificial Sequence: Synthetic peptide
  MOD_RES (16)..(16): Dpr
  c-term amidation

SEQ ID NO: 3695 - protein, 38 aa, Artificial Sequence; identical to SEQ ID NO: 3557
  Description of Artificial Sequence: Synthetic peptide
  MOD_RES (16)..(16): Dab
  c-term amidation

SEQ ID NO: 3696 - protein, 38 aa, Artificial Sequence; identical to SEQ ID NO: 3563
  Description of Artificial Sequence: Synthetic peptide
  MOD_RES (16)..(16): Orn
  c-term amidation

SEQ ID NO: 3697 - protein, 38 aa, Artificial Sequence; identical to SEQ ID NO: 3563
  Description of Artificial Sequence: Synthetic peptide
  MOD_RES (16)..(16): hLys
  c-term amidation

SEQ ID NO: 3698 - protein, 38 aa, Artificial Sequence; identical to SEQ ID NO: 3563
  Description of Artificial Sequence: Synthetic peptide
  MOD_RES (16)..(16): hArg
  c-term amidation

SEQ ID NO: 3699 - protein, 38 aa, Artificial Sequence; identical to SEQ ID NO: 3563
  Description of Artificial Sequence: Synthetic peptide
  MOD_RES (16)..(16): Cit
  c-term amidation

SEQ ID NO: 3700 - protein, 38 aa, Artificial Sequence; identical to SEQ ID NO: 3563
  Description of Artificial Sequence: Synthetic peptide
  MOD_RES (16)..(16): hCit
  c-term amidation

SEQ ID NO: 3701 - protein, 38 aa, Artificial Sequence; identical to SEQ ID NO: 3563
  Description of Artificial Sequence: Synthetic peptide
  MOD_RES (16)..(16): Dpr
  c-term amidation

SEQ ID NO: 3702 - protein, 38 aa, Artificial Sequence; identical to SEQ ID NO: 3563
  Description of Artificial Sequence: Synthetic peptide
  MOD_RES (16)..(16): Dab
  c-term amidation

SEQ ID NO: 3703 - protein, 38 aa, Artificial Sequence; identical to SEQ ID NO: 3570
  Description of Artificial Sequence: Synthetic peptide
  MOD_RES (16)..(16): Orn
  c-term amidation

SEQ ID NO: 3704 - protein, 38 aa, Artificial Sequence; identical to SEQ ID NO: 3570
  Description of Artificial Sequence: Synthetic peptide
  MOD_RES (16)..(16): hLys
  c-term amidation

SEQ ID NO: 3705 - protein, 38 aa, Artificial Sequence; identical to SEQ ID NO: 3570
  Description of Artificial Sequence: Synthetic peptide
  MOD_RES (16)..(16): hArg
  c-term amidation

SEQ ID NO: 3706 - protein, 38 aa, Artificial Sequence; identical to SEQ ID NO: 3570
  Description of Artificial Sequence: Synthetic peptide
  MOD_RES (16)..(16): Cit
  c-term amidation

SEQ ID NO: 3707 - protein, 38 aa, Artificial Sequence; identical to SEQ ID NO: 3570
  Description of Artificial Sequence: Synthetic peptide
  MOD_RES (16)..(16): hCit
  c-term amidation

SEQ ID NO: 3708 - protein, 38 aa, Artificial Sequence; identical to SEQ ID NO: 3570
  Description of Artificial Sequence: Synthetic peptide
  MOD_RES (16)..(16): Dpr
  c-term amidation

SEQ ID NO: 3709 - protein, 38 aa, Artificial Sequence; identical to SEQ ID NO: 3570
  Description of Artificial Sequence: Synthetic peptide
  MOD_RES (16)..(16): Dab
  c-term amidation

SEQ ID NO: 3710 - protein, 35 aa, Artificial Sequence; identical to SEQ ID NO: 3577
  Description of Artificial Sequence: Synthetic peptide
  MOD_RES (16)..(16): Orn
  c-term amidation

SEQ ID NO: 3711 - protein, 35 aa, Artificial Sequence; identical to SEQ ID NO: 3577
  Description of Artificial Sequence: Synthetic peptide
  MOD_RES (16)..(16): hLys
  c-term amidation

SEQ ID NO: 3712 - protein, 35 aa, Artificial Sequence; identical to SEQ ID NO: 3577
  Description of Artificial Sequence: Synthetic peptide
  MOD_RES (16)..(16): hArg
  c-term amidation

SEQ ID NO: 3713 - protein, 35 aa, Artificial Sequence; identical to SEQ ID NO: 3577
  Description of Artificial Sequence: Synthetic peptide
  MOD_RES (16)..(16): Cit
  c-term amidation

SEQ ID NO: 3714 - protein, 35 aa, Artificial Sequence; identical to SEQ ID NO: 3577
  Description of Artificial Sequence: Synthetic peptide
  MOD_RES (16)..(16): hCit
  c-term amidation

SEQ ID NO: 3715 - protein, 35 aa, Artificial Sequence; identical to SEQ ID NO: 3577
  Description of Artificial Sequence: Synthetic peptide
  MOD_RES (16)..(16): Dpr
  c-term amidation

SEQ ID NO: 3716 - protein, 33 aa, Artificial Sequence
  Description of Artificial Sequence: Synthetic peptide
  MOD_RES (16)..(16): Orn
  c-term amidation
GVIINVKCKISRQCLXPCKEAGMRFGACMNGKC

SEQ ID NO: 3717 - protein, 33 aa, Artificial Sequence; identical to SEQ ID NO: 3716
  Description of Artificial Sequence: Synthetic peptide
  MOD_RES (16)..(16): hLys
  c-term amidation

SEQ ID NO: 3718 - protein, 33 aa, Artificial Sequence; identical to SEQ ID NO: 3716
  Description of Artificial Sequence: Synthetic peptide
  MOD_RES (16)..(16): hArg
  c-term amidation

SEQ ID NO: 3719 - protein, 33 aa, Artificial Sequence; identical to SEQ ID NO: 3716
  Description of Artificial Sequence: Synthetic peptide
  MOD_RES (16)..(16): Cit
  c-term amidation

SEQ ID NO: 3720 - protein, 35 aa, Artificial Sequence; identical to SEQ ID NO: 3577
  Description of Artificial Sequence: Synthetic peptide
  MOD_RES (16)..(16): hCit
  c-term amidation

SEQ ID NO: 3721 - protein, 33 aa, Artificial Sequence; identical to SEQ ID NO: 3716
  Description of Artificial Sequence: Synthetic peptide
  MOD_RES (16)..(16): Dpr
  c-term amidation

SEQ ID NO: 3722 - protein, 33 aa, Artificial Sequence; identical to SEQ ID NO: 3716
  Description of Artificial Sequence: Synthetic peptide
  MOD_RES (16)..(16): Dab
  c-term amidation

SEQ ID NO: 3723 - protein, 38 aa, Artificial Sequence
  Description of Artificial Sequence: Synthetic peptide
  c-term amidation
GVIINVKCKISRQCLKPCKEAGMRFGACMNGKCHCWGG

SEQ ID NO: 3724 - protein, 38 aa, Artificial Sequence; identical to SEQ ID NO: 3591
  Description of Artificial Sequence: Synthetic peptide
  MOD_RES (16)..(16): Orn
  c-term amidation

SEQ ID NO: 3725 - protein, 38 aa, Artificial Sequence; identical to SEQ ID NO: 3591
  Description of Artificial Sequence: Synthetic peptide
  MOD_RES (16)..(16): hLys
  c-term amidation

SEQ ID NO: 3726 - protein, 38 aa, Artificial Sequence; identical to SEQ ID NO: 3591
  Description of Artificial Sequence: Synthetic peptide
  MOD_RES (16)..(16): hArg
  c-term amidation

SEQ ID NO: 3727 - protein, 38 aa, Artificial Sequence; identical to SEQ ID NO: 3591
  Description of Artificial Sequence: Synthetic peptide
  MOD_RES (16)..(16): Cit
  c-term amidation

SEQ ID NO: 3728 - protein, 38 aa, Artificial Sequence; identical to SEQ ID NO: 3591
  Description of Artificial Sequence: Synthetic peptide
  MOD_RES (16)..(16): hCit
  c-term amidation

SEQ ID NO: 3729 - protein, 38 aa, Artificial Sequence; identical to SEQ ID NO: 3591
  Description of Artificial Sequence: Synthetic peptide
  MOD_RES (16)..(16): Dpr
  c-term amidation

SEQ ID NO: 3730 - protein, 38 aa, Artificial Sequence; identical to SEQ ID NO: 3591
  Description of Artificial Sequence: Synthetic peptide
  MOD_RES (16)..(16): Dab
  c-term amidation

SEQ ID NO: 3731 - protein, 38 aa, Artificial Sequence
  Description of Artificial Sequence: Synthetic peptide
  c-term amidation
GVIINVKCKISRQCLKPCKEAGMRFGACMNGKCACYGG

SEQ ID NO: 3732 - protein, 38 aa, Artificial Sequence; identical to SEQ ID NO: 3601
  Description of Artificial Sequence: Synthetic peptide
  MOD_RES (16)..(16): Orn
  c-term amidation

SEQ ID NO: 3733 - protein, 38 aa, Artificial Sequence; identical to SEQ ID NO: 3601
  Description of Artificial Sequence: Synthetic peptide
  MOD_RES (16)..(16): hLys
  c-term amidation

SEQ ID NO: 3734 - protein, 38 aa, Artificial Sequence; identical to SEQ ID NO: 3601
  Description of Artificial Sequence: Synthetic peptide
  MOD_RES (16)..(16): hArg
  c-term amidation

SEQ ID NO: 3735 - protein, 38 aa, Artificial Sequence; identical to SEQ ID NO: 3601
  Description of Artificial Sequence: Synthetic peptide
  MOD_RES (16)..(16): Cit
  c-term amidation

SEQ ID NO: 3736 - protein, 38 aa, Artificial Sequence; identical to SEQ ID NO: 3591
  Description of Artificial Sequence: Synthetic peptide
  MOD_RES (16)..(16): hCit
  c-term amidation

SEQ ID NO: 3737 - protein, 38 aa, Artificial Sequence; identical to SEQ ID NO: 3601
  Description of Artificial Sequence: Synthetic peptide
  MOD_RES (16)..(16): Dpr
  c-term amidation

SEQ ID NO: 3738 - protein, 38 aa, Artificial Sequence; identical to SEQ ID NO: 3601
  Description of Artificial Sequence: Synthetic peptide
  MOD_RES (16)..(16): Dab
  c-term amidation

SEQ ID NO: 3739 - protein, 38 aa, Artificial Sequence; identical to SEQ ID NO: 3609
  Description of Artificial Sequence: Synthetic peptide
  MOD_RES (16)..(16): Orn
  c-term amidation

SEQ ID NO: 3740 - protein, 38 aa, Artificial Sequence; identical to SEQ ID NO: 3609
  Description of Artificial Sequence: Synthetic peptide
  MOD_RES (16)..(16): hLys
  c-term amidation

SEQ ID NO: 3741 - protein, 38 aa, Artificial Sequence; identical to SEQ ID NO: 3609
  Description of Artificial Sequence: Synthetic peptide
  MOD_RES (16)..(16): hArg
  c-term amidation

SEQ ID NO: 3742 - protein, 38 aa, Artificial Sequence; identical to SEQ ID NO: 3609
  Description of Artificial Sequence: Synthetic peptide
  MOD_RES (16)..(16): Cit
  c-term amidation

SEQ ID NO: 3743 - protein, 38 aa, Artificial Sequence; identical to SEQ ID NO: 3609
  Description of Artificial Sequence: Synthetic peptide
  MOD_RES (16)..(16): hCit
  c-term amidation

SEQ ID NO: 3744 - protein, 38 aa, Artificial Sequence; identical to SEQ ID NO: 3609
  Description of Artificial Sequence: Synthetic peptide
  MOD_RES (16)..(16): Dpr
  c-term amidation

SEQ ID NO: 3745 - protein, 38 aa, Artificial Sequence; identical to SEQ ID NO: 3615
  Description of Artificial Sequence: Synthetic peptide
  MOD_RES (16)..(16): Orn
  c-term amidation

SEQ ID NO: 3746 - protein, 38 aa, Artificial Sequence; identical to SEQ ID NO: 3615
  Description of Artificial Sequence: Synthetic peptide
  MOD_RES (16)..(16): hLys
  c-term amidation

SEQ ID NO: 3747 - protein, 38 aa, Artificial Sequence; identical to SEQ ID NO: 3615
  Description of Artificial Sequence: Synthetic peptide
  MOD_RES (16)..(16): hArg
  c-term amidation

SEQ ID NO: 3748 - protein, 38 aa, Artificial Sequence; identical to SEQ ID NO: 3615
  Description of Artificial Sequence: Synthetic peptide
  MOD_RES (16)..(16): Cit
  c-term amidation

SEQ ID NO: 3749 - protein, 37 aa, Artificial Sequence; identical to SEQ ID NO: 3619
  Description of Artificial Sequence: Synthetic peptide
  MOD_RES (16)..(16): hCit
  c-term amidation

SEQ ID NO: 3750 - protein, 38 aa, Artificial Sequence; identical to SEQ ID NO: 3615
  Description of Artificial Sequence: Synthetic peptide
  MOD_RES (16)..(16): Dpr
  c-term amidation

SEQ ID NO: 3751 - protein, 38 aa, Artificial Sequence; identical to SEQ ID NO: 3615
  Description of Artificial Sequence: Synthetic peptide
  MOD_RES (16)..(16): Dab
  c-term amidation

SEQ ID NO: 3752 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGACMNGKCACYGG

SEQ ID NO: 3753 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGACMNGKCACGGG

SEQ ID NO: 3754 - protein, 36 aa, Artificial Sequence
  Description of Artificial Sequence: Synthetic peptide
  MOD_RES (20)..(20): Cpa
  c-term amidation
GVIINVKCKISRQCLKPCKXAGMRFGACMNGKCACY

SEQ ID NO: 3755 - protein, 38 aa, Artificial Sequence; identical to SEQ ID NO: 3531
  Description of Artificial Sequence: Synthetic peptide
  c-term amidation

SEQ ID NO: 3756 - protein, 38 aa, Artificial Sequence; identical to SEQ ID NO: 3752
  Description of Artificial Sequence: Synthetic peptide
  MOD_RES (20)..(20): Aad
  c-term amidation

SEQ ID NO: 3757 - protein, 38 aa, Artificial Sequence
  Description of Artificial Sequence: Synthetic peptide
  MOD_RES (20)..(20): Aad
  c-term amidation
GVIINVKCKISRQCLKPCKXAGMRFGACMNGKCHCYGG

SEQ ID NO: 3758 - protein, 38 aa, Artificial Sequence; identical to SEQ ID NO: 3752
  Description of Artificial Sequence: Synthetic peptide
  MOD_RES (20)..(20): Aad
  c-term amidation

SEQ ID NO: 3759 - protein, 38 aa, Artificial Sequence
  Description of Artificial Sequence: Synthetic peptide
  c-term amidation
GVIINVKCKISRQCLHPCKDAGMRFGACMNGKCACYGG

SEQ ID NO: 3760 - protein, 38 aa, Artificial Sequence; identical to SEQ ID NO: 3759
  Description of Artificial Sequence: Synthetic peptide
  c-term amidation

SEQ ID NO: 3761 - protein, 36 aa, Artificial Sequence
  Description of Artificial Sequence: Synthetic peptide
  c-term amidation
GVIINVKCKISRQCLHPCKDAGMRFGACMNGKCACY

SEQ ID NO: 3762 - protein, 38 aa, Artificial Sequence
  Description of Artificial Sequence: Synthetic peptide
  c-term amidation
GVIINVKCKISRQCLHPCKDAGMRFGACMNGKCHCYGG

SEQ ID NO: 3763 - protein, 38 aa, Artificial Sequence; identical to SEQ ID NO: 3762
  Description of Artificial Sequence: Synthetic peptide

SEQ ID NO: 3764 - protein, 38 aa, Artificial Sequence
  Description of Artificial Sequence: Synthetic peptide
GVIINVKCKISRQCLHPCKDAGMRFGACMNGKCHCYPK

SEQ ID NO: 3765 - protein, 35 aa, Artificial Sequence
  Description of Artificial Sequence: Synthetic peptide
GVIINVKCKISRQCLHPCKDAGMRFGACMNGKCAC

SEQ ID NO: 3766 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGACMNGKCACXGG

SEQ ID NO: 3767 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGACMNGKCACXPK

SEQ ID NO: 3768 - protein, 38 aa, Artificial Sequence; identical to SEQ ID NO: 3766
  Description of Artificial Sequence: Synthetic peptide
  MOD_RES (36)..(36): 2Nal
  c-term amidation

SEQ ID NO: 3769 - protein, 38 aa, Artificial Sequence; identical to SEQ ID NO: 3766
  Description of Artificial Sequence: Synthetic peptide
  MOD_RES (36)..(36): Cha
  c-term amidation

SEQ ID NO: 3770 - protein, 38 aa, Artificial Sequence; identical to SEQ ID NO: 3766
  Description of Artificial Sequence: Synthetic peptide
  MOD_RES (36)..(36): MePhe
  c-term amidation

SEQ ID NO: 3771 - protein, 38 aa, Artificial Sequence; identical to SEQ ID NO: 3766
  Description of Artificial Sequence: Synthetic peptide
  MOD_RES (36)..(36): BiPhA
  c-term amidation

SEQ ID NO: 3772 - protein, 38 aa, Artificial Sequence
  Description of Artificial Sequence: Synthetic peptide
  MOD_RES (34)..(34): Aib
  c-term amidation
GVIINVKCKISRQCLKPCKDAGMRFGACMNGKCXCYGG

SEQ ID NO: 3773 - protein, 38 aa, Artificial Sequence; identical to SEQ ID NO: 3772
  Description of Artificial Sequence: Synthetic peptide
  MOD_RES (34)..(34): Abu
  c-term amidation

SEQ ID NO: 3774 - protein, 36 aa, Artificial Sequence
  Description of Artificial Sequence: Synthetic peptide
  MOD_RES (36)..(36): 1Nal
GVIINVKCKISRQCLKPCKDAGMRFGACMNGKCACX

SEQ ID NO: 3775 - protein, 38 aa, Artificial Sequence
  Description of Artificial Sequence: Synthetic peptide
  MOD_RES (36)..(36): 1Nal
  c-term amidation
GVIINVKCKISRQCLHPCKDAGMRFGACMNGKCACXGG

SEQ ID NO: 3776 - protein, 36 aa, Artificial Sequence; identical to SEQ ID NO: 3774
  Description of Artificial Sequence: Synthetic peptide
  MOD_RES (36)..(36): 4Bip
  c-term amidation

SEQ ID NO: 3777 - protein, 38 aa, Artificial Sequence; identical to SEQ ID NO: 3775
  Description of Artificial Sequence: Synthetic peptide
  MOD_RES (36)..(36): 4Bip
  c-term amidation

SEQ ID NO: 3778 - protein, 38 aa, Artificial Sequence
  Description of Artificial Sequence: Synthetic peptide
GVIINVKCKISRQCLKPCKDAGMRFGACMNGKCHCGGG

SEQ ID NO: 3779 - protein, 38 aa, Artificial Sequence; identical to SEQ ID NO: 1424
  Description of Artificial Sequence: Synthetic peptide

SEQ ID NO: 3780 - protein, 38 aa, Artificial Sequence
  Description of Artificial Sequence: Synthetic peptide
GVIINVSCKISRQCLEPCKKAGMRFGKCANGKCHCTPK

SEQ ID NO: 3781 - protein, 38 aa, Artificial Sequence
  Description of Artificial Sequence: Synthetic peptide
GVIINVKCKISRQCLKPCKKAGMRFGKCANGKCHCTPK

SEQ ID NO: 3782 - protein, 38 aa, Artificial Sequence
  Description of Artificial Sequence: Synthetic peptide
GVIINVKCKISRQCLEPCKDAGMRFGKCANGKCHCTPK

SEQ ID NO: 3783 - protein, 38 aa, Artificial Sequence
  Description of Artificial Sequence: Synthetic peptide
GVIINVKCKISRQCLKPCKDAGMRFGKCANGKCHCTPK

SEQ ID NO: 3784 - protein, 38 aa, Artificial Sequence
  Description of Artificial Sequence: Synthetic peptide
GVIINVSCKISRQCLKPCKDAGMRFGKCANGKCHCTPK

SEQ ID NO: 3785 - protein, 38 aa, Artificial Sequence; identical to SEQ ID NO: 2661
  Description of Artificial Sequence: Synthetic peptide

SEQ ID NO: 3786 - protein, 38 aa, Artificial Sequence
  Description of Artificial Sequence: Synthetic peptide
GVIINVKCKISRQCLKPCKDAGMRFGKCANGKCHCYPK

SEQ ID NO: 3787 - protein, 38 aa, Artificial Sequence; identical to SEQ ID NO: 2661
  Description of Artificial Sequence: Synthetic peptide
  n-term acetylation

SEQ ID NO: 3788 - protein, 38 aa, Artificial Sequence; identical to SEQ ID NO: 2661
  Description of Artificial Sequence: Synthetic peptide
  c-term amidation

SEQ ID NO: 3789 - protein, 38 aa, Artificial Sequence; identical to SEQ ID NO: 2661
  Description of Artificial Sequence: Synthetic peptide
  n-term acetylation
  c-term amidation

SEQ ID NO: 3790 - protein, 38 aa, Artificial Sequence; identical to SEQ ID NO: 3786
  Description of Artificial Sequence: Synthetic peptide
  c-term amidation

SEQ ID NO: 3791 - protein, 38 aa, Artificial Sequence; identical to SEQ ID NO: 3786
  Description of Artificial Sequence: Synthetic peptide
  n-term acetylation

SEQ ID NO: 3792 - protein, 38 aa, Artificial Sequence; identical to SEQ ID NO: 3786
  Description of Artificial Sequence: Synthetic peptide
  n-term acetylation
  c-term amidation

SEQ ID NO: 3793 - protein, 38 aa, Artificial Sequence; identical to SEQ ID NO: 3781
  Description of Artificial Sequence: Synthetic peptide
  c-term amidation

SEQ ID NO: 3794 - protein, 38 aa, Artificial Sequence; identical to SEQ ID NO: 3781
  Description of Artificial Sequence: Synthetic peptide
  n-term acetylation

SEQ ID NO: 3795 - protein, 38 aa, Artificial Sequence; identical to SEQ ID NO: 3781
  Description of Artificial Sequence: Synthetic peptide
  n-term acetylation
  c-term amidation

SEQ ID NO: 3796 - protein, 38 aa, Artificial Sequence; identical to SEQ ID NO: 3782
  Description of Artificial Sequence: Synthetic peptide
  n-term acetylation

SEQ ID NO: 3797 - protein, 38 aa, Artificial Sequence; identical to SEQ ID NO: 3782
  Description of Artificial Sequence: Synthetic peptide
  c-term amidation

SEQ ID NO: 3798 - protein, 38 aa, Artificial Sequence; identical to SEQ ID NO: 3782
  Description of Artificial Sequence: Synthetic peptide
  n-term acetylation
  c-term amidation

SEQ ID NO: 3799 - protein, 38 aa, Artificial Sequence; identical to SEQ ID NO: 1424
  Description of Artificial Sequence: Synthetic peptide
  c-term amidation

SEQ ID NO: 3800 - protein, 38 aa, Artificial Sequence; identical to SEQ ID NO: 1424
  Description of Artificial Sequence: Synthetic peptide
  n-term acetylation

SEQ ID NO: 3801 - protein, 38 aa, Artificial Sequence; identical to SEQ ID NO: 1424
  Description of Artificial Sequence: Synthetic peptide
  n-term acetylation
  c-term amidation

SEQ ID NO: 3802 - protein, 38 aa, Artificial Sequence; identical to SEQ ID NO: 3783
  Description of Artificial Sequence: Synthetic peptide
  c-term amidation

SEQ ID NO: 3803 - protein, 38 aa, Artificial Sequence; identical to SEQ ID NO: 3783
  Description of Artificial Sequence: Synthetic peptide
  n-term acetylation

SEQ ID NO: 3804 - protein, 38 aa, Artificial Sequence; identical to SEQ ID NO: 3783
  Description of Artificial Sequence: Synthetic peptide
  n-term acetylation
  c-term amidation

SEQ ID NO: 3805 - protein, 37 aa, Artificial Sequence
  Description of Artificial Sequence: Synthetic peptide
VIINVKCKISRQCLEPCKKAGMRFGKCANGKCHCTPK

SEQ ID NO: 3806 - protein, 37 aa, Artificial Sequence; identical to SEQ ID NO: 3805
  Description of Artificial Sequence: Synthetic peptide
  n-term acetylation

SEQ ID NO: 3807 - protein, 37 aa, Artificial Sequence; identical to SEQ ID NO: 3805
  Description of Artificial Sequence: Synthetic peptide
  c-term amidation

SEQ ID NO: 3808 - protein, 37 aa, Artificial Sequence; identical to SEQ ID NO: 3805
  Description of Artificial Sequence: Synthetic peptide
  n-term acetylation
  c-term amidation

SEQ ID NO: 3809 - protein, 38 aa, Artificial Sequence
  Description of Artificial Sequence: Synthetic peptide
GVIINVKCKISRQCLEPCKKAGMRFGKCANGKCACTPK

SEQ ID NO: 3810 - protein, 38 aa, Artificial Sequence; identical to SEQ ID NO: 3809
  Description of Artificial Sequence: Synthetic peptide
  n-term acetylation

SEQ ID NO: 3811 - protein, 38 aa, Artificial Sequence; identical to SEQ ID NO: 3809
  Description of Artificial Sequence: Synthetic peptide
  c-term amidation

SEQ ID NO: 3812 - protein, 38 aa, Artificial Sequence; identical to SEQ ID NO: 3809
  Description of Artificial Sequence: Synthetic peptide
  n-term acetylation
  c-term amidation

SEQ ID NO: 3813 - protein, 37 aa, Artificial Sequence
  Description of Artificial Sequence: Synthetic peptide
VIINVKCKISRQCLKPCKDAGMRFGKCANGKCHCTPK

SEQ ID NO: 3814 - protein, 37 aa, Artificial Sequence; identical to SEQ ID NO: 3813
  Description of Artificial Sequence: Synthetic peptide
  n-term acetylation

SEQ ID NO: 3815 - protein, 37 aa, Artificial Sequence; identical to SEQ ID NO: 3813
  Description of Artificial Sequence: Synthetic peptide
  c-term amidation

SEQ ID NO: 3816 - protein, 37 aa, Artificial Sequence; identical to SEQ ID NO: 3813
  Description of Artificial Sequence: Synthetic peptide
  n-term acetylation
  c-term amidation

SEQ ID NO: 3817 - protein, 34 aa, Artificial Sequence
  Description of Artificial Sequence: Synthetic peptide
NVKCKISRQCLKPCKDAGMRFGKCANGKCHCTPK

SEQ ID NO: 3818 - protein, 34 aa, Artificial Sequence; identical to SEQ ID NO: 3817
  Description of Artificial Sequence: Synthetic peptide
  n-term acetylation

SEQ ID NO: 3819 - protein, 34 aa, Artificial Sequence; identical to SEQ ID NO: 3817
  Description of Artificial Sequence: Synthetic peptide
  c-term amidation

SEQ ID NO: 3820 - protein, 34 aa, Artificial Sequence; identical to SEQ ID NO: 3817
  Description of Artificial Sequence: Synthetic peptide
  n-term acetylation
  c-term amidation

SEQ ID NO: 3821 - protein, 32 aa, Artificial Sequence
  Description of Artificial Sequence: Synthetic peptide
KCKISRQCLKPCKDAGMRFGKCANGKCHCTPK

SEQ ID NO: 3822 - protein, 32 aa, Artificial Sequence; identical to SEQ ID NO: 3821
  Description of Artificial Sequence: Synthetic peptide
  n-term acetylation

SEQ ID NO: 3823 - protein, 32 aa, Artificial Sequence; identical to SEQ ID NO: 3821
  Description of Artificial Sequence: Synthetic peptide
  c-term amidation

SEQ ID NO: 3824 - protein, 32 aa, Artificial Sequence; identical to SEQ ID NO: 3821
  Description of Artificial Sequence: Synthetic peptide
  n-term acetylation
  c-term amidation

SEQ ID NO: 3825 - protein, 31 aa, Artificial Sequence
  Description of Artificial Sequence: Synthetic peptide
CKISRQCLKPCKDAGMRFGKCANGKCHCTPK

SEQ ID NO: 3826 - protein, 31 aa, Artificial Sequence; identical to SEQ ID NO: 3825
  Description of Artificial Sequence: Synthetic peptide
  n-term acetylation

SEQ ID NO: 3827 - protein, 31 aa, Artificial Sequence; identical to SEQ ID NO: 3825
  Description of Artificial Sequence: Synthetic peptide
  c-term amidation

SEQ ID NO: 3828 - protein, 31 aa, Artificial Sequence; identical to SEQ ID NO: 3825
  Description of Artificial Sequence: Synthetic peptide
  n-term acetylation
  c-term amidation

SEQ ID NO: 3829 - protein, 38 aa, Artificial Sequence
  Description of Artificial Sequence: Synthetic peptide
GVIINVKCKISRQCLKPCKDAGMRNGKCANGKCHCTPK

SEQ ID NO: 3830 - protein, 38 aa, Artificial Sequence; identical to SEQ ID NO: 3829
  Description of Artificial Sequence: Synthetic peptide
  c-term amidation

SEQ ID NO: 3831 - protein, 38 aa, Artificial Sequence; identical to SEQ ID NO: 3829
  Description of Artificial Sequence: Synthetic peptide
  n-term acetylation

SEQ ID NO: 3832 - protein, 38 aa, Artificial Sequence; identical to SEQ ID NO: 3829
  Description of Artificial Sequence: Synthetic peptide
  n-term acetylation
  c-term amidation

SEQ ID NO: 3833 - protein, 38 aa, Artificial Sequence; identical to SEQ ID NO: 608
  Description of Artificial Sequence: Synthetic peptide

SEQ ID NO: 3834 - protein, 38 aa, Artificial Sequence; identical to SEQ ID NO: 608
  Description of Artificial Sequence: Synthetic peptide
  c-term amidation

SEQ ID NO: 3835 - protein, 38 aa, Artificial Sequence; identical to SEQ ID NO: 608
  Description of Artificial Sequence: Synthetic peptide
  n-term acetylation

SEQ ID NO: 3836 - protein, 38 aa, Artificial Sequence; identical to SEQ ID NO: 608
  Description of Artificial Sequence: Synthetic peptide
  n-term acetylation
  c-term amidation

SEQ ID NO: 3837 - protein, 38 aa, Artificial Sequence; identical to SEQ ID NO: 2713
  Description of Artificial Sequence: Synthetic peptide

SEQ ID NO: 3838 - protein, 38 aa, Artificial Sequence; identical to SEQ ID NO: 2713
  Description of Artificial Sequence: Synthetic peptide
  n-term acetylation

SEQ ID NO: 3839 - protein, 38 aa, Artificial Sequence; identical to SEQ ID NO: 2713
  Description of Artificial Sequence: Synthetic peptide
  c-term amidation

SEQ ID NO: 3840 - protein, 38 aa, Artificial Sequence; identical to SEQ ID NO: 2713
  Description of Artificial Sequence: Synthetic peptide
  n-term acetylation
  c-term amidation

SEQ ID NO: 3841 - protein, 37 aa, Artificial Sequence
  Description of Artificial Sequence: Synthetic peptide
TIINVKCKISRQCLKPCKDAGMRFGKCANGKCHCTPK

SEQ ID NO: 3842 - protein, 37 aa, Artificial Sequence; identical to SEQ ID NO: 3841
  Description of Artificial Sequence: Synthetic peptide
  n-term acetylation

SEQ ID NO: 3843 - protein, 37 aa, Artificial Sequence; identical to SEQ ID NO: 3841
  Description of Artificial Sequence: Synthetic peptide
  c-term amidation

SEQ ID NO: 3844 - protein, 37 aa, Artificial Sequence; identical to SEQ ID NO: 3841
  Description of Artificial Sequence: Synthetic peptide
  n-term acetylation
  c-term amidation

SEQ ID NO: 3845 - protein, 38 aa, Artificial Sequence
  Description of Artificial Sequence: Synthetic peptide
GVKINVKCKISRQCLEPCKKAGMRFGKCANGKCHCTPK

SEQ ID NO: 3846 - protein, 38 aa, Artificial Sequence; identical to SEQ ID NO: 3845
  Description of Artificial Sequence: Synthetic peptide
  n-term acetylation

SEQ ID NO: 3847 - protein, 38 aa, Artificial Sequence; identical to SEQ ID NO: 3845
  Description of Artificial Sequence: Synthetic peptide
  c-term amidation

SEQ ID NO: 3848 - protein, 38 aa, Artificial Sequence; identical to SEQ ID NO: 3845
  Description of Artificial Sequence: Synthetic peptide
  n-term acetylation
  c-term amidation

SEQ ID NO: 3849 - protein, 38 aa, Artificial Sequence
  Description of Artificial Sequence: Synthetic peptide
GVKINVKCKISRQCLEPCKKAGMRFGKCANGKCACTPK

SEQ ID NO: 3850 - protein, 38 aa, Artificial Sequence
  Description of Artificial Sequence: Synthetic peptide
GVKINVKCKISRQCLKPCKDAGMRFGKCANGKCHCTPK

SEQ ID NO: 3851 - protein, 38 aa, Artificial Sequence
  Description of Artificial Sequence: Synthetic peptide
GVKINVKCKISRQCLKPCKDAGMRFGKCANGKCACTPK

SEQ ID NO: 3852 - protein, 38 aa, Artificial Sequence; identical to SEQ ID NO: 3849
  Description of Artificial Sequence: Synthetic peptide
  n-term acetylation

SEQ ID NO: 3853 - protein, 38 aa, Artificial Sequence; identical to SEQ ID NO: 3849
  Description of Artificial Sequence: Synthetic peptide
  c-term amidation

SEQ ID NO: 3854 - protein, 38 aa, Artificial Sequence; identical to SEQ ID NO: 3849
  Description of Artificial Sequence: Synthetic peptide
  n-term acetylation
  c-term amidation

SEQ ID NO: 3855 - protein, 38 aa, Artificial Sequence; identical to SEQ ID NO: 3851
  Description of Artificial Sequence: Synthetic peptide
  n-term acetylation

SEQ ID NO: 3856 - protein, 38 aa, Artificial Sequence; identical to SEQ ID NO: 3851
  Description of Artificial Sequence: Synthetic peptide
  c-term amidation

SEQ ID NO: 3857 - protein, 38 aa, Artificial Sequence; identical to SEQ ID NO: 3851
  Description of Artificial Sequence: Synthetic peptide
  n-term acetylation
  c-term amidation

SEQ ID NO: 3858 - protein, 38 aa, Artificial Sequence; identical to SEQ ID NO: 3850
  Description of Artificial Sequence: Synthetic peptide
  n-term acetylation

SEQ ID NO: 3859 - protein, 38 aa, Artificial Sequence; identical to SEQ ID NO: 3850
  Description of Artificial Sequence: Synthetic peptide
  c-term amidation

SEQ ID NO: 3860 - protein, 38 aa, Artificial Sequence; identical to SEQ ID NO: 3850
  Description of Artificial Sequence: Synthetic peptide
  n-term acetylation
  c-term amidation

SEQ ID NO: 3861 - protein, 36 aa, Artificial Sequence
  Description of Artificial Sequence: Synthetic peptide
GVIINVKCKISRQCLKPCKDAGMRFGKCANGKCHCT

SEQ ID NO: 3862 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCHCTPK

SEQ ID NO: 3863 - protein, 38 aa, Artificial Sequence; identical to SEQ ID NO: 3862
  Description of Artificial Sequence: Synthetic peptide
  MOD_RES (16)..(16): hLys

SEQ ID NO: 3864 - protein, 38 aa, Artificial Sequence; identical to SEQ ID NO: 3862
  Description of Artificial Sequence: Synthetic peptide
  MOD_RES (16)..(16): hArg

SEQ ID NO: 3865 - protein, 38 aa, Artificial Sequence; identical to SEQ ID NO: 3862
  Description of Artificial Sequence: Synthetic peptide
  MOD_RES (16)..(16): Cit

SEQ ID NO: 3866 - protein, 38 aa, Artificial Sequence; identical to SEQ ID NO: 3862
  Description of Artificial Sequence: Synthetic peptide
  MOD_RES (16)..(16): hCit

SEQ ID NO: 3867 - protein, 38 aa, Artificial Sequence; identical to SEQ ID NO: 3862
  Description of Artificial Sequence: Synthetic peptide
  MOD_RES (16)..(16): Dpr

SEQ ID NO: 3868 - protein, 38 aa, Artificial Sequence; identical to SEQ ID NO: 3862
  Description of Artificial Sequence: Synthetic peptide
  MOD_RES (16)..(16): Dab

SEQ ID NO: 3869 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCHCYPK

SEQ ID NO: 3870 - protein, 38 aa, Artificial Sequence; identical to SEQ ID NO: 3869
  Description of Artificial Sequence: Synthetic peptide
  MOD_RES (16)..(16): hLys

SEQ ID NO: 3871 - protein, 38 aa, Artificial Sequence; identical to SEQ ID NO: 3869
  Description of Artificial Sequence: Synthetic peptide
  MOD_RES (16)..(16): hArg

SEQ ID NO: 3872 - protein, 38 aa, Artificial Sequence; identical to SEQ ID NO: 3869
  Description of Artificial Sequence: Synthetic peptide
  MOD_RES (16)..(16): Cit

SEQ ID NO: 3873 - protein, 38 aa, Artificial Sequence; identical to SEQ ID NO: 3869
  Description of Artificial Sequence: Synthetic peptide
  MOD_RES (16)..(16): hCit

SEQ ID NO: 3874 - protein, 38 aa, Artificial Sequence; identical to SEQ ID NO: 3869
  Description of Artificial Sequence: Synthetic peptide
  MOD_RES (16)..(16): Dpr

SEQ ID NO: 3875 - protein, 38 aa, Artificial Sequence; identical to SEQ ID NO: 3869
  Description of Artificial Sequence: Synthetic peptide
  MOD_RES (16)..(16): Dab

SEQ ID NO: 3876 - protein, 38 aa, Artificial Sequence
  Description of Artificial Sequence: Synthetic peptide
GVIINVKCKISRQCLKPCKDAGMRFGKCANGKCACYPK

SEQ ID NO: 3877 - protein, 38 aa, Artificial Sequence
  Description of Artificial Sequence: Synthetic peptide
GVIINVKCKISRQCLKPCKDAGMRFGKCANGKCGCYPK

SEQ ID NO: 3878 - protein, 38 aa, Artificial Sequence
  Description of Artificial Sequence: Synthetic peptide
GVIINVKCKISRQCLKPCKDAGMRFGKCANGKCACFPK

SEQ ID NO: 3879 - protein, 38 aa, Artificial Sequence
  Description of Artificial Sequence: Synthetic peptide
GVIINVKCKISRQCLKPCKDAGMRFGKCANGKCACWPK

SEQ ID NO: 3880 - protein, 38 aa, Artificial Sequence
  Description of Artificial Sequence: Synthetic peptide
GVIINVKCKISRQCLKPCKEAGMRFGKCANGKCACYPK

SEQ ID NO: 3881 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCACTPK

SEQ ID NO: 3882 - protein, 38 aa, Artificial Sequence; identical to SEQ ID NO: 3881
  Description of Artificial Sequence: Synthetic peptide
  MOD_RES (16)..(16): hLys

SEQ ID NO: 3883 - protein, 38 aa, Artificial Sequence; identical to SEQ ID NO: 3881
  Description of Artificial Sequence: Synthetic peptide
  MOD_RES (16)..(16): hArg

SEQ ID NO: 3884 - protein, 38 aa, Artificial Sequence; identical to SEQ ID NO: 3881
  Description of Artificial Sequence: Synthetic peptide
  MOD_RES (16)..(16): Cit

SEQ ID NO: 3885 - protein, 38 aa, Artificial Sequence; identical to SEQ ID NO: 3862
  Description of Artificial Sequence: Synthetic peptide
  MOD_RES (16)..(16): hCit

SEQ ID NO: 3886 - protein, 38 aa, Artificial Sequence; identical to SEQ ID NO: 3881
  Description of Artificial Sequence: Synthetic peptide
  MOD_RES (16)..(16): Dpr

SEQ ID NO: 3887 - protein, 38 aa, Artificial Sequence; identical to SEQ ID NO: 3881
  Description of Artificial Sequence: Synthetic peptide
  MOD_RES (16)..(16): Dab

SEQ ID NO: 3888 - protein, 35 aa, Artificial Sequence
  Description of Artificial Sequence: Synthetic peptide
  MOD_RES (16)..(16): Orn
GVIINVKCKISRQCLXPCKDAGMRFGKCANGKCHC

SEQ ID NO: 3889 - protein, 35 aa, Artificial Sequence; identical to SEQ ID NO: 3888
  Description of Artificial Sequence: Synthetic peptide
  MOD_RES (16)..(16): hLys

SEQ ID NO: 3890 - protein, 35 aa, Artificial Sequence; identical to SEQ ID NO: 3888
  Description of Artificial Sequence: Synthetic peptide
  MOD_RES (16)..(16): hArg

SEQ ID NO: 3891 - protein, 35 aa, Artificial Sequence; identical to SEQ ID NO: 3888
  Description of Artificial Sequence: Synthetic peptide
  MOD_RES (16)..(16): Cit

SEQ ID NO: 3892 - protein, 35 aa, Artificial Sequence; identical to SEQ ID NO: 3888
  Description of Artificial Sequence: Synthetic peptide
  MOD_RES (16)..(16): hCit

SEQ ID NO: 3893 - protein, 35 aa, Artificial Sequence; identical to SEQ ID NO: 3888
  Description of Artificial Sequence: Synthetic peptide
  MOD_RES (16)..(16): Dpr

SEQ ID NO: 3894 - protein, 35 aa, Artificial Sequence; identical to SEQ ID NO: 3888
  Description of Artificial Sequence: Synthetic peptide
  MOD_RES (16)..(16): Dab

SEQ ID NO: 3895 - protein, 35 aa, Artificial Sequence
  Description of Artificial Sequence: Synthetic peptide
  MOD_RES (16)..(16): Orn
GVIINVKCKISRQCLXPCKDAGMRFGKCANGKCAC

SEQ ID NO: 3896 - protein, 35 aa, Artificial Sequence; identical to SEQ ID NO: 3895
  Description of Artificial Sequence: Synthetic peptide
  MOD_RES (16)..(16): hLys

SEQ ID NO: 3897 - protein, 35 aa, Artificial Sequence; identical to SEQ ID NO: 3895
  Description of Artificial Sequence: Synthetic peptide
  MOD_RES (16)..(16): hArg

SEQ ID NO: 3898 - protein, 35 aa, Artificial Sequence; identical to SEQ ID NO: 3895
  Description of Artificial Sequence: Synthetic peptide
  MOD_RES (16)..(16): Cit

SEQ ID NO: 3899 - protein, 35 aa, Artificial Sequence; identical to SEQ ID NO: 3888
  Description of Artificial Sequence: Synthetic peptide
  MOD_RES (16)..(16): hCit

SEQ ID NO: 3900 - protein, 35 aa, Artificial Sequence; identical to SEQ ID NO: 3895
  Description of Artificial Sequence: Synthetic peptide
  MOD_RES (16)..(16): Dpr

SEQ ID NO: 3901 - protein, 35 aa, Artificial Sequence; identical to SEQ ID NO: 3895
  Description of Artificial Sequence: Synthetic peptide
  MOD_RES (16)..(16): Dab

SEQ ID NO: 3902 - protein, 38 aa, Artificial Sequence
  Description of Artificial Sequence: Synthetic peptide
GVIINVKCKISRQCLKPCKDAGMRFGKCANGKCGCYGG

SEQ ID NO: 3903 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCHCYGG

SEQ ID NO: 3904 - protein, 38 aa, Artificial Sequence; identical to SEQ ID NO: 3903
  Description of Artificial Sequence: Synthetic peptide
  MOD_RES (16)..(16): hLys

SEQ ID NO: 3905 - protein, 38 aa, Artificial Sequence; identical to SEQ ID NO: 3903
  Description of Artificial Sequence: Synthetic peptide
  MOD_RES (16)..(16): hArg

SEQ ID NO: 3906 - protein, 38 aa, Artificial Sequence; identical to SEQ ID NO: 3903
  Description of Artificial Sequence: Synthetic peptide
  MOD_RES (16)..(16): Cit

SEQ ID NO: 3907 - protein, 38 aa, Artificial Sequence; identical to SEQ ID NO: 3903
  Description of Artificial Sequence: Synthetic peptide
  MOD_RES (16)..(16): hCit

SEQ ID NO: 3908 - protein, 38 aa, Artificial Sequence; identical to SEQ ID NO: 3903
  Description of Artificial Sequence: Synthetic peptide
  MOD_RES (16)..(16): Dpr

SEQ ID NO: 3909 - protein, 38 aa, Artificial Sequence
  Description of Artificial Sequence: Synthetic peptide
GVIINVKCKISRQCLKPCKDAGMRFGKCANGKCACYGG

SEQ ID NO: 3910 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCACYGG

SEQ ID NO: 3911 - protein, 38 aa, Artificial Sequence; identical to SEQ ID NO: 3910
  Description of Artificial Sequence: Synthetic peptide
  MOD_RES (16)..(16): hLys

SEQ ID NO: 3912 - protein, 38 aa, Artificial Sequence; identical to SEQ ID NO: 3910
  Description of Artificial Sequence: Synthetic peptide
  MOD_RES (16)..(16): hArg

SEQ ID NO: 3913 - protein, 38 aa, Artificial Sequence; identical to SEQ ID NO: 3910
  Description of Artificial Sequence: Synthetic peptide
  MOD_RES (16)..(16): Cit

SEQ ID NO: 3914 - protein, 38 aa, Artificial Sequence; identical to SEQ ID NO: 3903
  Description of Artificial Sequence: Synthetic peptide
  MOD_RES (16)..(16): hCit

SEQ ID NO: 3915 - protein, 38 aa, Artificial Sequence; identical to SEQ ID NO: 3910
  Description of Artificial Sequence: Synthetic peptide
  MOD_RES (16)..(16): Dpr

SEQ ID NO: 3916 - protein, 38 aa, Artificial Sequence; identical to SEQ ID NO: 3910
  Description of Artificial Sequence: Synthetic peptide
  MOD_RES (16)..(16): Dab

SEQ ID NO: 3917 - protein, 37 aa, Artificial Sequence
  Description of Artificial Sequence: Synthetic peptide
GVIINVKCKISRQCLKPCKDAGMRFGKCANGKCACYG

SEQ ID NO: 3918 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCHCGGG

SEQ ID NO: 3919 - protein, 38 aa, Artificial Sequence; identical to SEQ ID NO: 3918
  Description of Artificial Sequence: Synthetic peptide
  MOD_RES (16)..(16): hLys

SEQ ID NO: 3920 - protein, 38 aa, Artificial Sequence; identical to SEQ ID NO: 3918
  Description of Artificial Sequence: Synthetic peptide
  MOD_RES (16)..(16): hArg

SEQ ID NO: 3921 - protein, 38 aa, Artificial Sequence; identical to SEQ ID NO: 3918
  Description of Artificial Sequence: Synthetic peptide
  MOD_RES (16)..(16): Cit

SEQ ID NO: 3922 - protein, 38 aa, Artificial Sequence; identical to SEQ ID NO: 3918
  Description of Artificial Sequence: Synthetic peptide
  MOD_RES (16)..(16): hCit

SEQ ID NO: 3923 - protein, 38 aa, Artificial Sequence; identical to SEQ ID NO: 3918
  Description of Artificial Sequence: Synthetic peptide
  MOD_RES (16)..(16): Dpr

SEQ ID NO: 3924 - protein, 38 aa, Artificial Sequence
  Description of Artificial Sequence: Synthetic peptide
GVIINVKCKISRQCLKPCKDAGMRFGKCANGKCACFGG

SEQ ID NO: 3925 - protein, 38 aa, Artificial Sequence
  Description of Artificial Sequence: Synthetic peptide
  MOD_RES (16)..(16): Orn
GVIINVKCKISRQCLXPCKDAGMRFGKCANGKCACGGG

SEQ ID NO: 3926 - protein, 38 aa, Artificial Sequence; identical to SEQ ID NO: 3925
  Description of Artificial Sequence: Synthetic peptide
  MOD_RES (16)..(16): hLys

SEQ ID NO: 3927 - protein, 38 aa, Artificial Sequence; identical to SEQ ID NO: 3925
  Description of Artificial Sequence: Synthetic peptide
  MOD_RES (16)..(16): hArg

SEQ ID NO: 3928 - protein, 38 aa, Artificial Sequence; identical to SEQ ID NO: 3925
  Description of Artificial Sequence: Synthetic peptide
  MOD_RES (16)..(16): Cit

SEQ ID NO: 3929 - protein, 38 aa, Artificial Sequence; identical to SEQ ID NO: 3925
  Description of Artificial Sequence: Synthetic peptide
  MOD_RES (16)..(16): hCit

SEQ ID NO: 3930 - protein, 38 aa, Artificial Sequence; identical to SEQ ID NO: 3925
  Description of Artificial Sequence: Synthetic peptide
  MOD_RES (16)..(16): Dpr

SEQ ID NO: 3931 - protein, 38 aa, Artificial Sequence; identical to SEQ ID NO: 3925
  Description of Artificial Sequence: Synthetic peptide
  MOD_RES (16)..(16): Dab

SEQ ID NO: 3932 - protein, 37 aa, Artificial Sequence
  Description of Artificial Sequence: Synthetic peptide
GVIINVKCKISRQCLKPCKDAGMRFGKCANGKCACGG

SEQ ID NO: 3933 - protein, 37 aa, Artificial Sequence; identical to SEQ ID NO: 3917
  Description of Artificial Sequence: Synthetic peptide

SEQ ID NO: 3934 - protein, 37 aa, Artificial Sequence
  Description of Artificial Sequence: Synthetic peptide
  MOD_RES (16)..(16): Orn
GVIINVKCKISRQCLXPCKDAGMRFGKCANGKCACGG

SEQ ID NO: 3935 - protein, 38 aa, Artificial Sequence
  Description of Artificial Sequence: Synthetic peptide
  MOD_RES (16)..(16): hLys
GVIINVKCKISRQCLXPCKEAGMRFGKCANGKCHCTPK

SEQ ID NO: 3936 - protein, 38 aa, Artificial Sequence; identical to SEQ ID NO: 3935
  Description of Artificial Sequence: Synthetic peptide
  MOD_RES (16)..(16): hArg

SEQ ID NO: 3937 - protein, 38 aa, Artificial Sequence; identical to SEQ ID NO: 3935
  Description of Artificial Sequence: Synthetic peptide
  MOD_RES (16)..(16): Cit

SEQ ID NO: 3938 - protein, 38 aa, Artificial Sequence; identical to SEQ ID NO: 3935
  Description of Artificial Sequence: Synthetic peptide
  MOD_RES (16)..(16): hCit

SEQ ID NO: 3939 - protein, 38 aa, Artificial Sequence; identical to SEQ ID NO: 3935
  Description of Artificial Sequence: Synthetic peptide
  MOD_RES (16)..(16): Dpr

SEQ ID NO: 3940 - protein, 38 aa, Artificial Sequence; identical to SEQ ID NO: 3935
  Description of Artificial Sequence: Synthetic peptide
  MOD_RES (16)..(16): Dab

SEQ ID NO: 3941 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCHCYPK

SEQ ID NO: 3942 - protein, 38 aa, Artificial Sequence; identical to SEQ ID NO: 3941
  Description of Artificial Sequence: Synthetic peptide
  MOD_RES (16)..(16): hLys

SEQ ID NO: 3943 - protein, 38 aa, Artificial Sequence; identical to SEQ ID NO: 3941
  Description of Artificial Sequence: Synthetic peptide
  MOD_RES (16)..(16): hArg

SEQ ID NO: 3944 - protein, 38 aa, Artificial Sequence; identical to SEQ ID NO: 3941
  Description of Artificial Sequence: Synthetic peptide
  MOD_RES (16)..(16): Cit

SEQ ID NO: 3945 - protein, 38 aa, Artificial Sequence; identical to SEQ ID NO: 3941
  Description of Artificial Sequence: Synthetic peptide
  MOD_RES (16)..(16): hCit

SEQ ID NO: 3946 - protein, 38 aa, Artificial Sequence; identical to SEQ ID NO: 3941
  Description of Artificial Sequence: Synthetic peptide
  MOD_RES (16)..(16): Dpr

SEQ ID NO: 3947 - protein, 38 aa, Artificial Sequence; identical to SEQ ID NO: 3941
  Description of Artificial Sequence: Synthetic peptide
  MOD_RES (16)..(16): Dab

SEQ ID NO: 3948 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCACTPK

SEQ ID NO: 3949 - protein, 38 aa, Artificial Sequence; identical to SEQ ID NO: 3948
  Description of Artificial Sequence: Synthetic peptide
  MOD_RES (16)..(16): hLys

SEQ ID NO: 3950 - protein, 38 aa, Artificial Sequence; identical to SEQ ID NO: 3948
  Description of Artificial Sequence: Synthetic peptide
  MOD_RES (16)..(16): hArg

SEQ ID NO: 3951 - protein, 38 aa, Artificial Sequence; identical to SEQ ID NO: 3948
  Description of Artificial Sequence: Synthetic peptide
  MOD_RES (16)..(16): Cit

SEQ ID NO: 3952 - protein, 38 aa, Artificial Sequence; identical to SEQ ID NO: 3935
  Description of Artificial Sequence: Synthetic peptide
  MOD_RES (16)..(16): hCit

SEQ ID NO: 3953 - protein, 38 aa, Artificial Sequence; identical to SEQ ID NO: 3948
  Description of Artificial Sequence: Synthetic peptide
  MOD_RES (16)..(16): Dpr

SEQ ID NO: 3954 - protein, 38 aa, Artificial Sequence; identical to SEQ ID NO: 3948
  Description of Artificial Sequence: Synthetic peptide
  MOD_RES (16)..(16): Dab

SEQ ID NO: 3955 - protein, 35 aa, Artificial Sequence
  Description of Artificial Sequence: Synthetic peptide
  MOD_RES (16)..(16): Orn
GVIINVKCKISRQCLXPCKEAGMRFGKCANGKCHC

SEQ ID NO: 3956 - protein, 35 aa, Artificial Sequence; identical to SEQ ID NO: 3955
  Description of Artificial Sequence: Synthetic peptide
  MOD_RES (16)..(16): hLys

SEQ ID NO: 3957 - protein, 35 aa, Artificial Sequence; identical to SEQ ID NO: 3955
  Description of Artificial Sequence: Synthetic peptide
  MOD_RES (16)..(16): hArg

SEQ ID NO: 3958 - protein, 35 aa, Artificial Sequence; identical to SEQ ID NO: 3955
  Description of Artificial Sequence: Synthetic peptide
  MOD_RES (16)..(16): Cit

SEQ ID NO: 3959 - protein, 35 aa, Artificial Sequence; identical to SEQ ID NO: 3955
  Description of Artificial Sequence: Synthetic peptide
  MOD_RES (16)..(16): hCit

SEQ ID NO: 3960 - protein, 35 aa, Artificial Sequence; identical to SEQ ID NO: 3955
  Description of Artificial Sequence: Synthetic peptide
  MOD_RES (16)..(16): Dpr

SEQ ID NO: 3961 - protein, 35 aa, Artificial Sequence
  Description of Artificial Sequence: Synthetic peptide
  MOD_RES (16)..(16): Orn
GVIINVKCKISRQCLXPCKEAGMRFGKCANGKCAC

SEQ ID NO: 3962 - protein, 35 aa, Artificial Sequence; identical to SEQ ID NO: 3961
  Description of Artificial Sequence: Synthetic peptide
  MOD_RES (16)..(16): hLys

SEQ ID NO: 3963 - protein, 35 aa, Artificial Sequence; identical to SEQ ID NO: 3961
  Description of Artificial Sequence: Synthetic peptide
  MOD_RES (16)..(16): hArg

SEQ ID NO: 3964 - protein, 35 aa, Artificial Sequence; identical to SEQ ID NO: 3961
  Description of Artificial Sequence: Synthetic peptide
  MOD_RES (16)..(16): Cit

SEQ ID NO: 3965 - protein, 35 aa, Artificial Sequence; identical to SEQ ID NO: 3955
  Description of Artificial Sequence: Synthetic peptide
  MOD_RES (16)..(16): hCit

SEQ ID NO: 3966 - protein, 35 aa, Artificial Sequence; identical to SEQ ID NO: 3961
  Description of Artificial Sequence: Synthetic peptide
  MOD_RES (16)..(16): Dpr

SEQ ID NO: 3967 - protein, 35 aa, Artificial Sequence; identical to SEQ ID NO: 3961
  Description of Artificial Sequence: Synthetic peptide
  MOD_RES (16)..(16): Dab

SEQ ID NO: 3968 - protein, 38 aa, Artificial Sequence
  Description of Artificial Sequence: Synthetic peptide
GVIINVKCKISRQCLKPCKEAGMRFGKCANGKCHCYGG

SEQ ID NO: 3969 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCHCYGG

SEQ ID NO: 3970 - protein, 37 aa, Artificial Sequence
  Description of Artificial Sequence: Synthetic peptide
GVIINVKCKISRQCLKPCKEAGMRFGKCANGKCHCYG

SEQ ID NO: 3971 - protein, 37 aa, Artificial Sequence
  Description of Artificial Sequence: Synthetic peptide
GVIINVKCKISRQCLKPCKEAGMRFGKCANGKCACYG

SEQ ID NO: 3972 - protein, 38 aa, Artificial Sequence; identical to SEQ ID NO: 3969
  Description of Artificial Sequence: Synthetic peptide
  MOD_RES (16)..(16): hLys

SEQ ID NO: 3973 - protein, 38 aa, Artificial Sequence; identical to SEQ ID NO: 3969
  Description of Artificial Sequence: Synthetic peptide
  MOD_RES (16)..(16): hArg

SEQ ID NO: 3974 - protein, 38 aa, Artificial Sequence; identical to SEQ ID NO: 3969
  Description of Artificial Sequence: Synthetic peptide
  MOD_RES (16)..(16): Cit

SEQ ID NO: 3975 - protein, 38 aa, Artificial Sequence; identical to SEQ ID NO: 3969
  Description of Artificial Sequence: Synthetic peptide
  MOD_RES (16)..(16): hCit

SEQ ID NO: 3976 - protein, 38 aa, Artificial Sequence; identical to SEQ ID NO: 3969
  Description of Artificial Sequence: Synthetic peptide
  MOD_RES (16)..(16): Dpr

SEQ ID NO: 3977 - protein, 38 aa, Artificial Sequence; identical to SEQ ID NO: 3969
  Description of Artificial Sequence: Synthetic peptide
  MOD_RES (16)..(16): Dab

SEQ ID NO: 3978 - protein, 37 aa, Artificial Sequence; identical to SEQ ID NO: 3971
  Description of Artificial Sequence: Synthetic peptide

SEQ ID NO: 3979 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCACYGG

SEQ ID NO: 3980 - protein, 38 aa, Artificial Sequence; identical to SEQ ID NO: 3979
  Description of Artificial Sequence: Synthetic peptide
  MOD_RES (16)..(16): hLys

SEQ ID NO: 3981 - protein, 38 aa, Artificial Sequence; identical to SEQ ID NO: 3979
  Description of Artificial Sequence: Synthetic peptide
  MOD_RES (16)..(16): hArg

SEQ ID NO: 3982 - protein, 38 aa, Artificial Sequence; identical to SEQ ID NO: 3979
  Description of Artificial Sequence: Synthetic peptide
  MOD_RES (16)..(16): Cit

SEQ ID NO: 3983 - protein, 38 aa, Artificial Sequence; identical to SEQ ID NO: 3969
  Description of Artificial Sequence: Synthetic peptide
  MOD_RES (16)..(16): hCit

SEQ ID NO: 3984 - protein, 38 aa, Artificial Sequence; identical to SEQ ID NO: 3979
  Description of Artificial Sequence: Synthetic peptide
  MOD_RES (16)..(16): Dpr

SEQ ID NO: 3985 - protein, 38 aa, Artificial Sequence; identical to SEQ ID NO: 3979
  Description of Artificial Sequence: Synthetic peptide
  MOD_RES (16)..(16): Dab

SEQ ID NO: 3986 - protein, 38 aa, Artificial Sequence
  Description of Artificial Sequence: Synthetic peptide
GVIINVKCKISRQCLKPCKEAGMRFGKCANGKCACFGG

SEQ ID NO: 3987 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCHCGGG

SEQ ID NO: 3988 - protein, 38 aa, Artificial Sequence; identical to SEQ ID NO: 3987
  Description of Artificial Sequence: Synthetic peptide
  MOD_RES (16)..(16): hLys

SEQ ID NO: 3989 - protein, 38 aa, Artificial Sequence; identical to SEQ ID NO: 3987
  Description of Artificial Sequence: Synthetic peptide
  MOD_RES (16)..(16): hArg

SEQ ID NO: 3990 - protein, 38 aa, Artificial Sequence; identical to SEQ ID NO: 3987
  Description of Artificial Sequence: Synthetic peptide
  MOD_RES (16)..(16): Cit

SEQ ID NO: 3991 - protein, 38 aa, Artificial Sequence; identical to SEQ ID NO: 3987
  Description of Artificial Sequence: Synthetic peptide
  MOD_RES (16)..(16): hCit

SEQ ID NO: 3992 - protein, 38 aa, Artificial Sequence; identical to SEQ ID NO: 3987
  Description of Artificial Sequence: Synthetic peptide
  MOD_RES (16)..(16): Dpr

SEQ ID NO: 3993 - protein, 38 aa, Artificial Sequence
  Description of Artificial Sequence: Synthetic peptide
  MOD_RES (16)..(16): Orn
GVIINVKCKISRQCLXPCKEAGMRFGKCANGKCACGGG

SEQ ID NO: 3994 - protein, 38 aa, Artificial Sequence; identical to SEQ ID NO: 3993
  Description of Artificial Sequence: Synthetic peptide
  MOD_RES (16)..(16): hLys

SEQ ID NO: 3995 - protein, 38 aa, Artificial Sequence; identical to SEQ ID NO: 3993
  Description of Artificial Sequence: Synthetic peptide
  MOD_RES (16)..(16): hArg

SEQ ID NO: 3996 - protein, 38 aa, Artificial Sequence; identical to SEQ ID NO: 3993
  Description of Artificial Sequence: Synthetic peptide
  MOD_RES (16)..(16): Cit

SEQ ID NO: 3997 - protein, 37 aa, Artificial Sequence
  Description of Artificial Sequence: Synthetic peptide
  MOD_RES (16)..(16): hCit
GVIINVKCKISRQCLXPCKEAGMRFGKCANGKCACTP

SEQ ID NO: 3998 - protein, 37 aa, Artificial Sequence; identical to SEQ ID NO: 3997
  Description of Artificial Sequence: Synthetic peptide
  MOD_RES (16)..(16): Dpr

SEQ ID NO: 3999 - protein, 37 aa, Artificial Sequence; identical to SEQ ID NO: 3997
  Description of Artificial Sequence: Synthetic peptide
  MOD_RES (16)..(16): Dab

SEQ ID NO: 4000 - protein, 38 aa, Artificial Sequence; identical to SEQ ID NO: 3862
  Description of Artificial Sequence: Synthetic peptide
  MOD_RES (16)..(16): Orn
  c-term amidation

SEQ ID NO: 4001 - protein, 38 aa, Artificial Sequence; identical to SEQ ID NO: 3862
  Description of Artificial Sequence: Synthetic peptide
  MOD_RES (16)..(16): hLys
  c-term amidation

SEQ ID NO: 4002 - protein, 38 aa, Artificial Sequence; identical to SEQ ID NO: 3862
  Description of Artificial Sequence: Synthetic peptide
  MOD_RES (16)..(16): hArg
  c-term amidation

SEQ ID NO: 4003 - protein, 38 aa, Artificial Sequence; identical to SEQ ID NO: 3862
  Description of Artificial Sequence: Synthetic peptide
  MOD_RES (16)..(16): Cit
  c-term amidation

SEQ ID NO: 4004 - protein, 38 aa, Artificial Sequence; identical to SEQ ID NO: 3862
  Description of Artificial Sequence: Synthetic peptide
  MOD_RES (16)..(16): hCit
  c-term amidation

SEQ ID NO: 4005 - protein, 38 aa, Artificial Sequence; identical to SEQ ID NO: 3862
  Description of Artificial Sequence: Synthetic peptide
  MOD_RES (16)..(16): Dpr
  c-term amidation

SEQ ID NO: 4006 - protein, 38 aa, Artificial Sequence; identical to SEQ ID NO: 3862
  Description of Artificial Sequence: Synthetic peptide
  MOD_RES (16)..(16): Dab
  c-term amidation

SEQ ID NO: 4007 - protein, 38 aa, Artificial Sequence; identical to SEQ ID NO: 3869
  Description of Artificial Sequence: Synthetic peptide
  MOD_RES (16)..(16): Orn
  c-term amidation

SEQ ID NO: 4008 - protein, 38 aa, Artificial Sequence; identical to SEQ ID NO: 3869
  Description of Artificial Sequence: Synthetic peptide
  MOD_RES (16)..(16): hLys
  c-term amidation

SEQ ID NO: 4009 - protein, 38 aa, Artificial Sequence; identical to SEQ ID NO: 3869
  Description of Artificial Sequence: Synthetic peptide
  MOD_RES (16)..(16): hArg
  c-term amidation

SEQ ID NO: 4010 - protein, 38 aa, Artificial Sequence; identical to SEQ ID NO: 3869
  Description of Artificial Sequence: Synthetic peptide
  MOD_RES (16)..(16): Cit
  c-term amidation

SEQ ID NO: 4011 - protein, 38 aa, Artificial Sequence; identical to SEQ ID NO: 3869
  Description of Artificial Sequence: Synthetic peptide
  MOD_RES (16)..(16): hCit
  c-term amidation

SEQ ID NO: 4012 - protein, 38 aa, Artificial Sequence; identical to SEQ ID NO: 3869
  Description of Artificial Sequence: Synthetic peptide
  MOD_RES (16)..(16): Dpr
  c-term amidation

SEQ ID NO: 4013 - protein, 38 aa, Artificial Sequence; identical to SEQ ID NO: 3869
  Description of Artificial Sequence: Synthetic peptide
  MOD_RES (16)..(16): Dab
  c-term amidation

SEQ ID NO: 4014 - protein, 38 aa, Artificial Sequence; identical to SEQ ID NO: 3881
  Description of Artificial Sequence: Synthetic peptide
  MOD_RES (16)..(16): Orn
  c-term amidation

SEQ ID NO: 4015 - protein, 38 aa, Artificial Sequence; identical to SEQ ID NO: 3881
  Description of Artificial Sequence: Synthetic peptide
  MOD_RES (16)..(16): hLys
  c-term amidation

SEQ ID NO: 4016 - protein, 38 aa, Artificial Sequence; identical to SEQ ID NO: 3881
  Description of Artificial Sequence: Synthetic peptide
  MOD_RES (16)..(16): hArg
  c-term amidation

SEQ ID NO: 4017 - protein, 38 aa, Artificial Sequence; identical to SEQ ID NO: 3881
  Description of Artificial Sequence: Synthetic peptide
  MOD_RES (16)..(16): Cit
  c-term amidation

SEQ ID NO: 4018 - protein, 38 aa, Artificial Sequence; identical to SEQ ID NO: 3881
  Description of Artificial Sequence: Synthetic peptide
  MOD_RES (16)..(16): hCit
  c-term amidation

SEQ ID NO: 4019 - protein, 38 aa, Artificial Sequence; identical to SEQ ID NO: 3881
  Description of Artificial Sequence: Synthetic peptide
  MOD_RES (16)..(16): Dpr
  c-term amidation

SEQ ID NO: 4020 - protein, 38 aa, Artificial Sequence; identical to SEQ ID NO: 3881
  Description of Artificial Sequence: Synthetic peptide
  MOD_RES (16)..(16): Dab
  c-term amidation

SEQ ID NO: 4021 - protein, 35 aa, Artificial Sequence; identical to SEQ ID NO: 3888
  Description of Artificial Sequence: Synthetic peptide
  MOD_RES (16)..(16): Orn
  c-term amidation

SEQ ID NO: 4022 - protein, 35 aa, Artificial Sequence; identical to SEQ ID NO: 3888
  Description of Artificial Sequence: Synthetic peptide
  MOD_RES (16)..(16): hLys
  c-term amidation

SEQ ID NO: 4023 - protein, 35 aa, Artificial Sequence; identical to SEQ ID NO: 3888
  Description of Artificial Sequence: Synthetic peptide
  MOD_RES (16)..(16): hArg
  c-term amidation

SEQ ID NO: 4024 - protein, 35 aa, Artificial Sequence; identical to SEQ ID NO: 3888
  Description of Artificial Sequence: Synthetic peptide
  MOD_RES (16)..(16): Cit
  c-term amidation

SEQ ID NO: 4025 - protein, 35 aa, Artificial Sequence; identical to SEQ ID NO: 3888
  Description of Artificial Sequence: Synthetic peptide
  MOD_RES (16)..(16): hCit
  c-term amidation

SEQ ID NO: 4026 - protein, 35 aa, Artificial Sequence; identical to SEQ ID NO: 3888
  Description of Artificial Sequence: Synthetic peptide
  MOD_RES (16)..(16): Dpr
  c-term amidation

SEQ ID NO: 4027 - protein, 33 aa, Artificial Sequence
  Description of Artificial Sequence: Synthetic peptide
  MOD_RES (16)..(16): Orn
  c-term amidation
GVIINVKCKISRQCLXPCKDAGMRFGKCANGKC

SEQ ID NO: 4028 - protein, 33 aa, Artificial Sequence; identical to SEQ ID NO: 4027
  Description of Artificial Sequence: Synthetic peptide
  MOD_RES (16)..(16): hLys
  c-term amidation

SEQ ID NO: 4029 - protein, 33 aa, Artificial Sequence; identical to SEQ ID NO: 4027
  Description of Artificial Sequence: Synthetic peptide
  MOD_RES (16)..(16): hArg
  c-term amidation

SEQ ID NO: 4030 - protein, 33 aa, Artificial Sequence; identical to SEQ ID NO: 4027
  Description of Artificial Sequence: Synthetic peptide
  MOD_RES (16)..(16): Cit
  c-term amidation

SEQ ID NO: 4031 - protein, 35 aa, Artificial Sequence; identical to SEQ ID NO: 3888
  Description of Artificial Sequence: Synthetic peptide
  MOD_RES (16)..(16): hCit
  c-term amidation

SEQ ID NO: 4032 - protein, 33 aa, Artificial Sequence; identical to SEQ ID NO: 4027
  Description of Artificial Sequence: Synthetic peptide
  MOD_RES (16)..(16): Dpr
  c-term amidation

SEQ ID NO: 4033 - protein, 33 aa, Artificial Sequence; identical to SEQ ID NO: 4027
  Description of Artificial Sequence: Synthetic peptide
  MOD_RES (16)..(16): Dab
  c-term amidation

SEQ ID NO: 4034 - protein, 38 aa, Artificial Sequence
  Description of Artificial Sequence: Synthetic peptide
  c-term amidation
GVIINVKCKISRQCLKPCKDAGMRFGKCANGKCHCYGG

SEQ ID NO: 4035 - protein, 38 aa, Artificial Sequence; identical to SEQ ID NO: 3903
  Description of Artificial Sequence: Synthetic peptide
  MOD_RES (16)..(16): Orn
  c-term amidation

SEQ ID NO: 4036 - protein, 38 aa, Artificial Sequence; identical to SEQ ID NO: 3903
  Description of Artificial Sequence: Synthetic peptide
  MOD_RES (16)..(16): hLys
  c-term amidation

SEQ ID NO: 4037 - protein, 38 aa, Artificial Sequence; identical to SEQ ID NO: 3903
  Description of Artificial Sequence: Synthetic peptide
  MOD_RES (16)..(16): hArg
  c-term amidation

SEQ ID NO: 4038 - protein, 38 aa, Artificial Sequence; identical to SEQ ID NO: 3903
  Description of Artificial Sequence: Synthetic peptide
  MOD_RES (16)..(16): Cit
  c-term amidation

SEQ ID NO: 4039 - protein, 38 aa, Artificial Sequence; identical to SEQ ID NO: 3903
  Description of Artificial Sequence: Synthetic peptide
  MOD_RES (16)..(16): hCit
  c-term amidation

SEQ ID NO: 4040 - protein, 38 aa, Artificial Sequence; identical to SEQ ID NO: 3903
  Description of Artificial Sequence: Synthetic peptide
  MOD_RES (16)..(16): Dpr
  c-term amidation

SEQ ID NO: 4041 - protein, 38 aa, Artificial Sequence
  Description of Artificial Sequence: Synthetic peptide
  c-term amidation
GVIINVKCKISRQCLKPCKDAGMRFGKCANGKCHCFGG

SEQ ID NO: 4042 - protein, 37 aa, Artificial Sequence
  Description of Artificial Sequence: Synthetic peptide
  c-term amidation
GVIINVKCKISRQCLKPCKDAGMRFGKCANGKCHCYG

SEQ ID NO: 4043 - protein, 37 aa, Artificial Sequence; identical to SEQ ID NO: 3917
  Description of Artificial Sequence: Synthetic peptide
  c-term amidation

SEQ ID NO: 4044 - protein, 38 aa, Artificial Sequence; identical to SEQ ID NO: 3910
  Description of Artificial Sequence: Synthetic peptide
  MOD_RES (16)..(16): Orn
  c-term amidation

SEQ ID NO: 4045 - protein, 38 aa, Artificial Sequence; identical to SEQ ID NO: 3910
  Description of Artificial Sequence: Synthetic peptide
  MOD_RES (16)..(16): hLys
  c-term amidation

SEQ ID NO: 4046 - protein, 38 aa, Artificial Sequence; identical to SEQ ID NO: 3910
  Description of Artificial Sequence: Synthetic peptide
  MOD_RES (16)..(16): hArg
  c-term amidation

SEQ ID NO: 4047 - protein, 38 aa, Artificial Sequence; identical to SEQ ID NO: 3910
  Description of Artificial Sequence: Synthetic peptide
  MOD_RES (16)..(16): Cit
  c-term amidation

SEQ ID NO: 4048 - protein, 38 aa, Artificial Sequence; identical to SEQ ID NO: 3910
  Description of Artificial Sequence: Synthetic peptide
  MOD_RES (16)..(16): hCit
  c-term amidation

SEQ ID NO: 4049 - protein, 38 aa, Artificial Sequence; identical to SEQ ID NO: 3910
  Description of Artificial Sequence: Synthetic peptide
  MOD_RES (16)..(16): Dpr
  c-term amidation

SEQ ID NO: 4050 - protein, 38 aa, Artificial Sequence; identical to SEQ ID NO: 3910
  Description of Artificial Sequence: Synthetic peptide
  MOD_RES (16)..(16): Dab
  c-term amidation

SEQ ID NO: 4051 - protein, 38 aa, Artificial Sequence; identical to SEQ ID NO: 3909
  Description of Artificial Sequence: Synthetic peptide
  c-term amidation

SEQ ID NO: 4052 - protein, 38 aa, Artificial Sequence; identical to SEQ ID NO: 3918
  Description of Artificial Sequence: Synthetic peptide
  MOD_RES (16)..(16): Orn
  c-term amidation

SEQ ID NO: 4053 - protein, 38 aa, Artificial Sequence; identical to SEQ ID NO: 3918
  Description of Artificial Sequence: Synthetic peptide
  MOD_RES (16)..(16): hLys
  c-term amidation

SEQ ID NO: 4054 - protein, 38 aa, Artificial Sequence; identical to SEQ ID NO: 3918
  Description of Artificial Sequence: Synthetic peptide
  MOD_RES (16)..(16): hArg
  c-term amidation

SEQ ID NO: 4055 - protein, 38 aa, Artificial Sequence; identical to SEQ ID NO: 3918
  Description of Artificial Sequence: Synthetic peptide
  MOD_RES (16)..(16): Cit
  c-term amidation

SEQ ID NO: 4056 - protein, 38 aa, Artificial Sequence; identical to SEQ ID NO: 3918
  Description of Artificial Sequence: Synthetic peptide
  MOD_RES (16)..(16): hCit
  c-term amidation

SEQ ID NO: 4057 - protein, 38 aa, Artificial Sequence; identical to SEQ ID NO: 3918
  Description of Artificial Sequence: Synthetic peptide
  MOD_RES (16)..(16): Dpr
  c-term amidation

SEQ ID NO: 4058 - protein, 38 aa, Artificial Sequence
  Description of Artificial Sequence: Synthetic peptide
  c-term amidation
GVIINVKCKISRQCLKPCKDAGMRFGKCANGKCACGGG

SEQ ID NO: 4059 - protein, 38 aa, Artificial Sequence
  Description of Artificial Sequence: Synthetic peptide
  MOD_RES (16)..(16): Orn
  c-term amidation
GVIINVKCKISRQCLXPCKDAGMRFGKCANGKCACFGG

SEQ ID NO: 4060 - protein, 38 aa, Artificial Sequence; identical to SEQ ID NO: 3925
  Description of Artificial Sequence: Synthetic peptide
  MOD_RES (16)..(16): Orn
  c-term amidation

SEQ ID NO: 4061 - protein, 38 aa, Artificial Sequence; identical to SEQ ID NO: 3925
  Description of Artificial Sequence: Synthetic peptide
  MOD_RES (16)..(16): hLys
  c-term amidation

SEQ ID NO: 4062 - protein, 38 aa, Artificial Sequence; identical to SEQ ID NO: 3925
  Description of Artificial Sequence: Synthetic peptide
  MOD_RES (16)..(16): hArg
  c-term amidation

SEQ ID NO: 4063 - protein, 38 aa, Artificial Sequence; identical to SEQ ID NO: 3925
  Description of Artificial Sequence: Synthetic peptide
  MOD_RES (16)..(16): Cit
  c-term amidation

SEQ ID NO: 4064 - protein, 38 aa, Artificial Sequence; identical to SEQ ID NO: 3925
  Description of Artificial Sequence: Synthetic peptide
  MOD_RES (16)..(16): hCit
  c-term amidation

SEQ ID NO: 4065 - protein, 38 aa, Artificial Sequence; identical to SEQ ID NO: 3925
  Description of Artificial Sequence: Synthetic peptide
  MOD_RES (16)..(16): Dpr
  c-term amidation

SEQ ID NO: 4066 - protein, 38 aa, Artificial Sequence; identical to SEQ ID NO: 3925
  Description of Artificial Sequence: Synthetic peptide
  MOD_RES (16)..(16): Dab
  c-term amidation

SEQ ID NO: 4067 - protein, 38 aa, Artificial Sequence; identical to SEQ ID NO: 3935
  Description of Artificial Sequence: Synthetic peptide
  MOD_RES (16)..(16): Orn
  c-term amidation

SEQ ID NO: 4068 - protein, 38 aa, Artificial Sequence; identical to SEQ ID NO: 3935
  Description of Artificial Sequence: Synthetic peptide
  MOD_RES (16)..(16): hLys
  c-term amidation

SEQ ID NO: 4069 - protein, 38 aa, Artificial Sequence; identical to SEQ ID NO: 3935
  Description of Artificial Sequence: Synthetic peptide
  MOD_RES (16)..(16): hArg
  c-term amidation

SEQ ID NO: 4070 - protein, 38 aa, Artificial Sequence; identical to SEQ ID NO: 3935
  Description of Artificial Sequence: Synthetic peptide
  MOD_RES (16)..(16): Cit
  c-term amidation

SEQ ID NO: 4071 - protein, 38 aa, Artificial Sequence; identical to SEQ ID NO: 3935
  Description of Artificial Sequence: Synthetic peptide
  MOD_RES (16)..(16): hCit
  c-term amidation

SEQ ID NO: 4072 - protein, 38 aa, Artificial Sequence; identical to SEQ ID NO: 3935
  Description of Artificial Sequence: Synthetic peptide
  MOD_RES (16)..(16): Dpr
  c-term amidation

SEQ ID NO: 4073 - protein, 38 aa, Artificial Sequence; identical to SEQ ID NO: 3935
  Description of Artificial Sequence: Synthetic peptide
  MOD_RES (16)..(16): Dab
  c-term amidation

SEQ ID NO: 4074 - protein, 38 aa, Artificial Sequence; identical to SEQ ID NO: 3941
  Description of Artificial Sequence: Synthetic peptide
  MOD_RES (16)..(16): Orn
  c-term amidation

SEQ ID NO: 4075 - protein, 38 aa, Artificial Sequence; identical to SEQ ID NO: 3941
  Description of Artificial Sequence: Synthetic peptide
  MOD_RES (16)..(16): hLys
  c-term amidation

SEQ ID NO: 4076 - protein, 38 aa, Artificial Sequence; identical to SEQ ID NO: 3941
  Description of Artificial Sequence: Synthetic peptide
  MOD_RES (16)..(16): hArg
  c-term amidation

SEQ ID NO: 4077 - protein, 38 aa, Artificial Sequence; identical to SEQ ID NO: 3941
  Description of Artificial Sequence: Synthetic peptide
  MOD_RES (16)..(16): Cit
  c-term amidation

SEQ ID NO: 4078 - protein, 38 aa, Artificial Sequence; identical to SEQ ID NO: 3941
  Description of Artificial Sequence: Synthetic peptide
  MOD_RES (16)..(16): hCit
  c-term amidation

SEQ ID NO: 4079 - protein, 38 aa, Artificial Sequence; identical to SEQ ID NO: 3941
  Description of Artificial Sequence: Synthetic peptide
  MOD_RES (16)..(16): Dpr
  c-term amidation

SEQ ID NO: 4080 - protein, 38 aa, Artificial Sequence; identical to SEQ ID NO: 3941
  Description of Artificial Sequence: Synthetic peptide
  MOD_RES (16)..(16): Dab
  c-term amidation

SEQ ID NO: 4081 - protein, 38 aa, Artificial Sequence; identical to SEQ ID NO: 3948
  Description of Artificial Sequence: Synthetic peptide
  MOD_RES (16)..(16): Orn
  c-term amidation

SEQ ID NO: 4082 - protein, 38 aa, Artificial Sequence; identical to SEQ ID NO: 3948
  Description of Artificial Sequence: Synthetic peptide
  MOD_RES (16)..(16): hLys
  c-term amidation

SEQ ID NO: 4083 - protein, 38 aa, Artificial Sequence; identical to SEQ ID NO: 3948
  Description of Artificial Sequence: Synthetic peptide
  MOD_RES (16)..(16): hArg
  c-term amidation

SEQ ID NO: 4084 - protein, 38 aa, Artificial Sequence; identical to SEQ ID NO: 3948
  Description of Artificial Sequence: Synthetic peptide
  MOD_RES (16)..(16): Cit
  c-term amidation

SEQ ID NO: 4085 - protein, 38 aa, Artificial Sequence; identical to SEQ ID NO: 3948
  Description of Artificial Sequence: Synthetic peptide
  MOD_RES (16)..(16): hCit
  c-term amidation

SEQ ID NO: 4086 - protein, 38 aa, Artificial Sequence; identical to SEQ ID NO: 3948
  Description of Artificial Sequence: Synthetic peptide
  MOD_RES (16)..(16): Dpr
  c-term amidation

SEQ ID NO: 4087 - protein, 38 aa, Artificial Sequence; identical to SEQ ID NO: 3948
  Description of Artificial Sequence: Synthetic peptide
  MOD_RES (16)..(16): Dab
  c-term amidation

SEQ ID NO: 4088 - protein, 35 aa, Artificial Sequence; identical to SEQ ID NO: 3955
  Description of Artificial Sequence: Synthetic peptide
  MOD_RES (16)..(16): Orn
  c-term amidation

SEQ ID NO: 4089 - protein, 35 aa, Artificial Sequence; identical to SEQ ID NO: 3955
  Description of Artificial Sequence: Synthetic peptide
  MOD_RES (16)..(16): hLys
  c-term amidation

SEQ ID NO: 4090 - protein, 35 aa, Artificial Sequence; identical to SEQ ID NO: 3955
  Description of Artificial Sequence: Synthetic peptide
  MOD_RES (16)..(16): hArg
  c-term amidation

SEQ ID NO: 4091 - protein, 35 aa, Artificial Sequence; identical to SEQ ID NO: 3955
  Description of Artificial Sequence: Synthetic peptide
  MOD_RES (16)..(16): Cit
  c-term amidation

SEQ ID NO: 4092 - protein, 35 aa, Artificial Sequence; identical to SEQ ID NO: 3955
  Description of Artificial Sequence: Synthetic peptide
  MOD_RES (16)..(16): hCit
  c-term amidation

SEQ ID NO: 4093 - protein, 35 aa, Artificial Sequence; identical to SEQ ID NO: 3955
  Description of Artificial Sequence: Synthetic peptide
  MOD_RES (16)..(16): Dpr
  c-term amidation

SEQ ID NO: 4094 - protein, 33 aa, Artificial Sequence
  Description of Artificial Sequence: Synthetic peptide
  MOD_RES (16)..(16): Orn
  c-term amidation
GVIINVKCKISRQCLXPCKEAGMRFGKCANGKC

SEQ ID NO: 4095 - protein, 33 aa, Artificial Sequence; identical to SEQ ID NO: 4094
  Description of Artificial Sequence: Synthetic peptide
  MOD_RES (16)..(16): hLys
  c-term amidation

SEQ ID NO: 4096 - protein, 33 aa, Artificial Sequence; identical to SEQ ID NO: 4094
  Description of Artificial Sequence: Synthetic peptide
  MOD_RES (16)..(16): hArg
  c-term amidation

SEQ ID NO: 4097 - protein, 33 aa, Artificial Sequence; identical to SEQ ID NO: 4094
  Description of Artificial Sequence: Synthetic peptide
  MOD_RES (16)..(16): Cit
  c-term amidation

SEQ ID NO: 4098 - protein, 35 aa, Artificial Sequence; identical to SEQ ID NO: 3955
  Description of Artificial Sequence: Synthetic peptide
  MOD_RES (16)..(16): hCit
  c-term amidation

SEQ ID NO: 4099 - protein, 33 aa, Artificial Sequence; identical to SEQ ID NO: 4094
  Description of Artificial Sequence: Synthetic peptide
  MOD_RES (16)..(16): Dpr
  c-term amidation

SEQ ID NO: 4100 - protein, 33 aa, Artificial Sequence; identical to SEQ ID NO: 4094
  Description of Artificial Sequence: Synthetic peptide
  MOD_RES (16)..(16): Dab
  c-term amidation

SEQ ID NO: 4101 - protein, 38 aa, Artificial Sequence
  Description of Artificial Sequence: Synthetic peptide
  c-term amidation
GVIINVKCKISRQCLKPCKEAGMRFGKCANGKCHCWGG

SEQ ID NO: 4102 - protein, 38 aa, Artificial Sequence; identical to SEQ ID NO: 3969
  Description of Artificial Sequence: Synthetic peptide
  MOD_RES (16)..(16): Orn
  c-term amidation

SEQ ID NO: 4103 - protein, 38 aa, Artificial Sequence; identical to SEQ ID NO: 3969
  Description of Artificial Sequence: Synthetic peptide
  MOD_RES (16)..(16): hLys
  c-term amidation

SEQ ID NO: 4104 - protein, 38 aa, Artificial Sequence; identical to SEQ ID NO: 3969
  Description of Artificial Sequence: Synthetic peptide
  MOD_RES (16)..(16): hArg
  c-term amidation

SEQ ID NO: 4105 - protein, 38 aa, Artificial Sequence; identical to SEQ ID NO: 3969
  Description of Artificial Sequence: Synthetic peptide
  MOD_RES (16)..(16): Cit
  c-term amidation

SEQ ID NO: 4106 - protein, 38 aa, Artificial Sequence; identical to SEQ ID NO: 3969
  Description of Artificial Sequence: Synthetic peptide
  MOD_RES (16)..(16): hCit
  c-term amidation

SEQ ID NO: 4107 - protein, 38 aa, Artificial Sequence; identical to SEQ ID NO: 3969
  Description of Artificial Sequence: Synthetic peptide
  MOD_RES (16)..(16): Dpr
  c-term amidation

SEQ ID NO: 4108 - protein, 38 aa, Artificial Sequence; identical to SEQ ID NO: 3969
  Description of Artificial Sequence: Synthetic peptide
  MOD_RES (16)..(16): Dab
  c-term amidation

SEQ ID NO: 4109 - protein, 38 aa, Artificial Sequence
  Description of Artificial Sequence: Synthetic peptide
  c-term amidation
GVIINVKCKISRQCLKPCKEAGMRFGKCANGKCACYGG

SEQ ID NO: 4110 - protein, 38 aa, Artificial Sequence; identical to SEQ ID NO: 3979
  Description of Artificial Sequence: Synthetic peptide
  MOD_RES (16)..(16): Orn
  c-term amidation

SEQ ID NO: 4111 - protein, 38 aa, Artificial Sequence; identical to SEQ ID NO: 3979
  Description of Artificial Sequence: Synthetic peptide
  MOD_RES (16)..(16): hLys
  c-term amidation

SEQ ID NO: 4112 - protein, 38 aa, Artificial Sequence; identical to SEQ ID NO: 3979
  Description of Artificial Sequence: Synthetic peptide
  MOD_RES (16)..(16): hArg
  c-term amidation

SEQ ID NO: 4113 - protein, 38 aa, Artificial Sequence; identical to SEQ ID NO: 3979
  Description of Artificial Sequence: Synthetic peptide
  MOD_RES (16)..(16): Cit
  c-term amidation

SEQ ID NO: 4114 - protein, 38 aa, Artificial Sequence; identical to SEQ ID NO: 3969
  Description of Artificial Sequence: Synthetic peptide
  MOD_RES (16)..(16): hCit
  c-term amidation

SEQ ID NO: 4115 - protein, 38 aa, Artificial Sequence; identical to SEQ ID NO: 3979
  Description of Artificial Sequence: Synthetic peptide
  MOD_RES (16)..(16): Dpr
  c-term amidation

SEQ ID NO: 4116 - protein, 38 aa, Artificial Sequence; identical to SEQ ID NO: 3979
  Description of Artificial Sequence: Synthetic peptide
  MOD_RES (16)..(16): Dab
  c-term amidation

SEQ ID NO: 4117 - protein, 38 aa, Artificial Sequence; identical to SEQ ID NO: 3987
  Description of Artificial Sequence: Synthetic peptide
  MOD_RES (16)..(16): Orn
  c-term amidation

SEQ ID NO: 4118 - protein, 38 aa, Artificial Sequence; identical to SEQ ID NO: 3987
  Description of Artificial Sequence: Synthetic peptide
  MOD_RES (16)..(16): hLys
  c-term amidation

SEQ ID NO: 4119 - protein, 38 aa, Artificial Sequence; identical to SEQ ID NO: 3987
  Description of Artificial Sequence: Synthetic peptide
  MOD_RES (16)..(16): hArg
  c-term amidation

SEQ ID NO: 4120 - protein, 38 aa, Artificial Sequence; identical to SEQ ID NO: 3987
  Description of Artificial Sequence: Synthetic peptide
  MOD_RES (16)..(16): Cit
  c-term amidation

SEQ ID NO: 4121 - protein, 38 aa, Artificial Sequence; identical to SEQ ID NO: 3987
  Description of Artificial Sequence: Synthetic peptide
  MOD_RES (16)..(16): hCit
  c-term amidation

SEQ ID NO: 4122 - protein, 38 aa, Artificial Sequence; identical to SEQ ID NO: 3987
  Description of Artificial Sequence: Synthetic peptide
  MOD_RES (16)..(16): Dpr
  c-term amidation

SEQ ID NO: 4123 - protein, 38 aa, Artificial Sequence; identical to SEQ ID NO: 3993
  Description of Artificial Sequence: Synthetic peptide
  MOD_RES (16)..(16): Orn
  c-term amidation

SEQ ID NO: 4124 - protein, 38 aa, Artificial Sequence; identical to SEQ ID NO: 3993
  Description of Artificial Sequence: Synthetic peptide
  MOD_RES (16)..(16): hLys
  c-term amidation

SEQ ID NO: 4125 - protein, 38 aa, Artificial Sequence; identical to SEQ ID NO: 3993
  Description of Artificial Sequence: Synthetic peptide
  MOD_RES (16)..(16): hArg
  c-term amidation

SEQ ID NO: 4126 - protein, 38 aa, Artificial Sequence; identical to SEQ ID NO: 3993
  Description of Artificial Sequence: Synthetic peptide
  MOD_RES (16)..(16): Cit
  c-term amidation

SEQ ID NO: 4127 - protein, 37 aa, Artificial Sequence; identical to SEQ ID NO: 3997
  Description of Artificial Sequence: Synthetic peptide
  MOD_RES (16)..(16): hCit
  c-term amidation

SEQ ID NO: 4128 - protein, 38 aa, Artificial Sequence; identical to SEQ ID NO: 3993
  Description of Artificial Sequence: Synthetic peptide
  MOD_RES (16)..(16): Dpr
  c-term amidation

SEQ ID NO: 4129 - protein, 38 aa, Artificial Sequence; identical to SEQ ID NO: 3993
  Description of Artificial Sequence: Synthetic peptide
  MOD_RES (16)..(16): Dab
  c-term amidation

SEQ ID NO: 4130 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGKCANGKCACYGG

SEQ ID NO: 4131 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGKCANGKCACGGG

SEQ ID NO: 4132 - protein, 36 aa, Artificial Sequence
  Description of Artificial Sequence: Synthetic peptide
  MOD_RES (20)..(20): Cpa
  c-term amidation
GVIINVKCKISRQCLKPCKXAGMRFGKCANGKCACY

SEQ ID NO: 4133 - protein, 38 aa, Artificial Sequence; identical to SEQ ID NO: 3909
  Description of Artificial Sequence: Synthetic peptide
  c-term amidation

SEQ ID NO: 4134 - protein, 38 aa, Artificial Sequence; identical to SEQ ID NO: 4130
  Description of Artificial Sequence: Synthetic peptide
  MOD_RES (20)..(20): Aad
  c-term amidation

SEQ ID NO: 4135 - protein, 38 aa, Artificial Sequence
  Description of Artificial Sequence: Synthetic peptide
  MOD_RES (20)..(20): Aad
  c-term amidation
GVIINVKCKISRQCLKPCKXAGMRFGKCANGKCHCYGG

SEQ ID NO: 4136 - protein, 38 aa, Artificial Sequence; identical to SEQ ID NO: 4130
  Description of Artificial Sequence: Synthetic peptide
  MOD_RES (20)..(20): Aad
  c-term amidation

SEQ ID NO: 4137 - protein, 38 aa, Artificial Sequence
  Description of Artificial Sequence: Synthetic peptide
  c-term amidation
GVIINVKCKISRQCLHPCKDAGMRFGKCANGKCACYGG

SEQ ID NO: 4138 - protein, 38 aa, Artificial Sequence; identical to SEQ ID NO: 4137
  Description of Artificial Sequence: Synthetic peptide
  c-term amidation

SEQ ID NO: 4139 - protein, 36 aa, Artificial Sequence
  Description of Artificial Sequence: Synthetic peptide
  c-term amidation
GVIINVKCKISRQCLHPCKDAGMRFGKCANGKCACY

SEQ ID NO: 4140 - protein, 38 aa, Artificial Sequence
  Description of Artificial Sequence: Synthetic peptide
  c-term amidation
GVIINVKCKISRQCLHPCKDAGMRFGKCANGKCHCYGG

SEQ ID NO: 4141 - protein, 38 aa, Artificial Sequence; identical to SEQ ID NO: 4140
  Description of Artificial Sequence: Synthetic peptide

SEQ ID NO: 4142 - protein, 38 aa, Artificial Sequence
  Description of Artificial Sequence: Synthetic peptide
GVIINVKCKISRQCLHPCKDAGMRFGKCANGKCHCYPK

SEQ ID NO: 4143 - protein, 35 aa, Artificial Sequence
  Description of Artificial Sequence: Synthetic peptide
GVIINVKCKISRQCLHPCKDAGMRFGKCANGKCAC

SEQ ID NO: 4144 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGKCANGKCACXGG

SEQ ID NO: 4145 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGKCANGKCACXPK

SEQ ID NO: 4146 - protein, 38 aa, Artificial Sequence; identical to SEQ ID NO: 4144
  Description of Artificial Sequence: Synthetic peptide
  MOD_RES (36)..(36): 2Nal
  c-term amidation

SEQ ID NO: 4147 - protein, 38 aa, Artificial Sequence; identical to SEQ ID NO: 4144
  Description of Artificial Sequence: Synthetic peptide
  MOD_RES (36)..(36): Cha
  c-term amidation

SEQ ID NO: 4148 - protein, 38 aa, Artificial Sequence; identical to SEQ ID NO: 4144
  Description of Artificial Sequence: Synthetic peptide
  MOD_RES (36)..(36): MePhe
  c-term amidation

SEQ ID NO: 4149 - protein, 38 aa, Artificial Sequence; identical to SEQ ID NO: 4144
  Description of Artificial Sequence: Synthetic peptide
  MOD_RES (36)..(36): BiPhA
  c-term amidation

SEQ ID NO: 4150 - protein, 38 aa, Artificial Sequence
  Description of Artificial Sequence: Synthetic peptide
  MOD_RES (34)..(34): Aib
  c-term amidation
GVIINVKCKISRQCLKPCKDAGMRFGKCANGKCXCYGG

SEQ ID NO: 4151 - protein, 38 aa, Artificial Sequence; identical to SEQ ID NO: 4150
  Description of Artificial Sequence: Synthetic peptide
  MOD_RES (34)..(34): Abu
  c-term amidation

SEQ ID NO: 4152 - protein, 36 aa, Artificial Sequence
  Description of Artificial Sequence: Synthetic peptide
  MOD_RES (36)..(36): 1Nal
GVIINVKCKISRQCLKPCKDAGMRFGKCANGKCACX

SEQ ID NO: 4153 - protein, 38 aa, Artificial Sequence
  Description of Artificial Sequence: Synthetic peptide
  MOD_RES (36)..(36): 1Nal
  c-term amidation
GVIINVKCKISRQCLHPCKDAGMRFGKCANGKCACXGG

SEQ ID NO: 4154 - protein, 36 aa, Artificial Sequence; identical to SEQ ID NO: 4152
  Description of Artificial Sequence: Synthetic peptide
  MOD_RES (36)..(36): 4Bip
  c-term amidation

SEQ ID NO: 4155 - protein, 38 aa, Artificial Sequence; identical to SEQ ID NO: 4153
  Description of Artificial Sequence: Synthetic peptide
  MOD_RES (36)..(36): 4Bip
  c-term amidation

SEQ ID NO: 4156 - protein, 38 aa, Artificial Sequence
  Description of Artificial Sequence: Synthetic peptide
GVIINVKCKISRQCLKPCKDAGMRFGKCANGKCHCGGG

SEQ ID NO: 4157 - protein, 38 aa, Artificial Sequence; identical to SEQ ID NO: 1425
  Description of Artificial Sequence: Synthetic peptide

SEQ ID NO: 4158 - protein, 38 aa, Artificial Sequence
  Description of Artificial Sequence: Synthetic peptide
GVIINVSCKISRQCLEPCKKAGMRFGKCMAGKCHCTPK

SEQ ID NO: 4159 - protein, 38 aa, Artificial Sequence
  Description of Artificial Sequence: Synthetic peptide
GVIINVKCKISRQCLKPCKKAGMRFGKCMAGKCHCTPK

SEQ ID NO: 4160 - protein, 38 aa, Artificial Sequence
  Description of Artificial Sequence: Synthetic peptide
GVIINVKCKISRQCLEPCKDAGMRFGKCMAGKCHCTPK

SEQ ID NO: 4161 - protein, 38 aa, Artificial Sequence
  Description of Artificial Sequence: Synthetic peptide
GVIINVKCKISRQCLKPCKDAGMRFGKCMAGKCHCTPK

SEQ ID NO: 4162 - protein, 38 aa, Artificial Sequence
  Description of Artificial Sequence: Synthetic peptide
GVIINVSCKISRQCLKPCKDAGMRFGKCMAGKCHCTPK

SEQ ID NO: 4163 - protein, 38 aa, Artificial Sequence; identical to SEQ ID NO: 3039
  Description of Artificial Sequence: Synthetic peptide

SEQ ID NO: 4164 - protein, 38 aa, Artificial Sequence
  Description of Artificial Sequence: Synthetic peptide
GVIINVKCKISRQCLKPCKDAGMRFGKCMAGKCHCYPK

SEQ ID NO: 4165 - protein, 38 aa, Artificial Sequence; identical to SEQ ID NO: 3039
  Description of Artificial Sequence: Synthetic peptide
  n-term acetylation

SEQ ID NO: 4166 - protein, 38 aa, Artificial Sequence; identical to SEQ ID NO: 3039
  Description of Artificial Sequence: Synthetic peptide
  c-term amidation

SEQ ID NO: 4167 - protein, 38 aa, Artificial Sequence; identical to SEQ ID NO: 3039
  Description of Artificial Sequence: Synthetic peptide
  n-term acetylation
  c-term amidation

SEQ ID NO: 4168 - protein, 38 aa, Artificial Sequence; identical to SEQ ID NO: 4164
  Description of Artificial Sequence: Synthetic peptide
  c-term amidation

SEQ ID NO: 4169 - protein, 38 aa, Artificial Sequence; identical to SEQ ID NO: 4164
  Description of Artificial Sequence: Synthetic peptide
  n-term acetylation

SEQ ID NO: 4170 - protein, 38 aa, Artificial Sequence; identical to SEQ ID NO: 4164
  Description of Artificial Sequence: Synthetic peptide
  n-term acetylation
  c-term amidation

SEQ ID NO: 4171 - protein, 38 aa, Artificial Sequence; identical to SEQ ID NO: 4159
  Description of Artificial Sequence: Synthetic peptide
  c-term amidation

SEQ ID NO: 4172 - protein, 38 aa, Artificial Sequence; identical to SEQ ID NO: 4159
  Description of Artificial Sequence: Synthetic peptide
  n-term acetylation

SEQ ID NO: 4173 - protein, 38 aa, Artificial Sequence; identical to SEQ ID NO: 4159
  Description of Artificial Sequence: Synthetic peptide
  n-term acetylation
  c-term amidation

SEQ ID NO: 4174 - protein, 38 aa, Artificial Sequence; identical to SEQ ID NO: 4160
  Description of Artificial Sequence: Synthetic peptide
  n-term acetylation

SEQ ID NO: 4175 - protein, 38 aa, Artificial Sequence; identical to SEQ ID NO: 4160
  Description of Artificial Sequence: Synthetic peptide
  c-term amidation

SEQ ID NO: 4176 - protein, 38 aa, Artificial Sequence; identical to SEQ ID NO: 4160
  Description of Artificial Sequence: Synthetic peptide
  n-term acetylation
  c-term amidation

SEQ ID NO: 4177 - protein, 38 aa, Artificial Sequence; identical to SEQ ID NO: 1425
  Description of Artificial Sequence: Synthetic peptide
  c-term amidation

SEQ ID NO: 4178 - protein, 38 aa, Artificial Sequence; identical to SEQ ID NO: 1425
  Description of Artificial Sequence: Synthetic peptide
  n-term acetylation

SEQ ID NO: 4179 - protein, 38 aa, Artificial Sequence; identical to SEQ ID NO: 1425
  Description of Artificial Sequence: Synthetic peptide
  n-term acetylation
  c-term amidation

SEQ ID NO: 4180 - protein, 38 aa, Artificial Sequence; identical to SEQ ID NO: 4161
  Description of Artificial Sequence: Synthetic peptide
  c-term amidation

SEQ ID NO: 4181 - protein, 38 aa, Artificial Sequence; identical to SEQ ID NO: 4161
  Description of Artificial Sequence: Synthetic peptide
  n-term acetylation

SEQ ID NO: 4182 - protein, 38 aa, Artificial Sequence; identical to SEQ ID NO: 4161
  Description of Artificial Sequence: Synthetic peptide
  n-term acetylation
  c-term amidation

SEQ ID NO: 4183 - protein, 37 aa, Artificial Sequence
  Description of Artificial Sequence: Synthetic peptide
VIINVKCKISRQCLEPCKKAGMRFGKCMAGKCHCTPK

SEQ ID NO: 4184 - protein, 37 aa, Artificial Sequence; identical to SEQ ID NO: 4183
  Description of Artificial Sequence: Synthetic peptide
  n-term acetylation

SEQ ID NO: 4185 - protein, 37 aa, Artificial Sequence; identical to SEQ ID NO: 4183
  Description of Artificial Sequence: Synthetic peptide
  c-term amidation

SEQ ID NO: 4186 - protein, 37 aa, Artificial Sequence; identical to SEQ ID NO: 4183
  Description of Artificial Sequence: Synthetic peptide
  n-term acetylation
  c-term amidation

SEQ ID NO: 4187 - protein, 38 aa, Artificial Sequence
  Description of Artificial Sequence: Synthetic peptide
GVIINVKCKISRQCLEPCKKAGMRFGKCMAGKCACTPK

SEQ ID NO: 4188 - protein, 38 aa, Artificial Sequence; identical to SEQ ID NO: 4187
  Description of Artificial Sequence: Synthetic peptide
  n-term acetylation

SEQ ID NO: 4189 - protein, 38 aa, Artificial Sequence; identical to SEQ ID NO: 4187
  Description of Artificial Sequence: Synthetic peptide
  c-term amidation

SEQ ID NO: 4190 - protein, 38 aa, Artificial Sequence; identical to SEQ ID NO: 4187
  Description of Artificial Sequence: Synthetic peptide
  n-term acetylation
  c-term amidation

SEQ ID NO: 4191 - protein, 37 aa, Artificial Sequence
  Description of Artificial Sequence: Synthetic peptide
VIINVKCKISRQCLKPCKDAGMRFGKCMAGKCHCTPK

SEQ ID NO: 4192 - protein, 37 aa, Artificial Sequence; identical to SEQ ID NO: 4191
  Description of Artificial Sequence: Synthetic peptide
  n-term acetylation

SEQ ID NO: 4193 - protein, 37 aa, Artificial Sequence; identical to SEQ ID NO: 4191
  Description of Artificial Sequence: Synthetic peptide
  c-term amidation

SEQ ID NO: 4194 - protein, 37 aa, Artificial Sequence; identical to SEQ ID NO: 4191
  Description of Artificial Sequence: Synthetic peptide
  n-term acetylation
  c-term amidation

SEQ ID NO: 4195 - protein, 34 aa, Artificial Sequence
  Description of Artificial Sequence: Synthetic peptide
NVKCKISRQCLKPCKDAGMRFGKCMAGKCHCTPK

SEQ ID NO: 4196 - protein, 34 aa, Artificial Sequence; identical to SEQ ID NO: 4195
  Description of Artificial Sequence: Synthetic peptide
  n-term acetylation

SEQ ID NO: 4197 - protein, 34 aa, Artificial Sequence; identical to SEQ ID NO: 4195
  Description of Artificial Sequence: Synthetic peptide
  c-term amidation

SEQ ID NO: 4198 - protein, 34 aa, Artificial Sequence; identical to SEQ ID NO: 4195
  Description of Artificial Sequence: Synthetic peptide
  n-term acetylation
  c-term amidation

SEQ ID NO: 4199 - protein, 32 aa, Artificial Sequence
  Description of Artificial Sequence: Synthetic peptide
KCKISRQCLKPCKDAGMRFGKCMAGKCHCTPK

SEQ ID NO: 4200 - protein, 32 aa, Artificial Sequence; identical to SEQ ID NO: 4199
  Description of Artificial Sequence: Synthetic peptide
  n-term acetylation

SEQ ID NO: 4201 - protein, 32 aa, Artificial Sequence; identical to SEQ ID NO: 4199
  Description of Artificial Sequence: Synthetic peptide
  c-term amidation

SEQ ID NO: 4202 - protein, 32 aa, Artificial Sequence; identical to SEQ ID NO: 4199
  Description of Artificial Sequence: Synthetic peptide
  n-term acetylation
  c-term amidation

SEQ ID NO: 4203 - protein, 31 aa, Artificial Sequence
  Description of Artificial Sequence: Synthetic peptide
CKISRQCLKPCKDAGMRFGKCMAGKCHCTPK

SEQ ID NO: 4204 - protein, 31 aa, Artificial Sequence; identical to SEQ ID NO: 4203
  Description of Artificial Sequence: Synthetic peptide
  n-term acetylation

SEQ ID NO: 4205 - protein, 31 aa, Artificial Sequence; identical to SEQ ID NO: 4203
  Description of Artificial Sequence: Synthetic peptide
  c-term amidation

SEQ ID NO: 4206 - protein, 31 aa, Artificial Sequence; identical to SEQ ID NO: 4203
  Description of Artificial Sequence: Synthetic peptide
  n-term acetylation
  c-term amidation

SEQ ID NO: 4207 - protein, 38 aa, Artificial Sequence
  Description of Artificial Sequence: Synthetic peptide
GVIINVKCKISRQCLKPCKDAGMRNGKCMAGKCHCTPK

SEQ ID NO: 4208 - protein, 38 aa, Artificial Sequence; identical to SEQ ID NO: 4207
  Description of Artificial Sequence: Synthetic peptide
  c-term amidation

SEQ ID NO: 4209 - protein, 38 aa, Artificial Sequence; identical to SEQ ID NO: 4207
  Description of Artificial Sequence: Synthetic peptide
  n-term acetylation

SEQ ID NO: 4210 - protein, 38 aa, Artificial Sequence; identical to SEQ ID NO: 4207
  Description of Artificial Sequence: Synthetic peptide
  n-term acetylation
  c-term amidation

SEQ ID NO: 4211 - protein, 38 aa, Artificial Sequence; identical to SEQ ID NO: 608
  Description of Artificial Sequence: Synthetic peptide

SEQ ID NO: 4212 - protein, 38 aa, Artificial Sequence; identical to SEQ ID NO: 608
  Description of Artificial Sequence: Synthetic peptide
  c-term amidation

SEQ ID NO: 4213 - protein, 38 aa, Artificial Sequence; identical to SEQ ID NO: 608
  Description of Artificial Sequence: Synthetic peptide
  n-term acetylation

SEQ ID NO: 4214 - protein, 38 aa, Artificial Sequence; identical to SEQ ID NO: 608
  Description of Artificial Sequence: Synthetic peptide
  n-term acetylation
  c-term amidation

SEQ ID NO: 4215 - protein, 38 aa, Artificial Sequence; identical to SEQ ID NO: 3091
  Description of Artificial Sequence: Synthetic peptide

SEQ ID NO: 4216 - protein, 38 aa, Artificial Sequence; identical to SEQ ID NO: 3091
  Description of Artificial Sequence: Synthetic peptide
  n-term acetylation

SEQ ID NO: 4217 - protein, 38 aa, Artificial Sequence; identical to SEQ ID NO: 3091
  Description of Artificial Sequence: Synthetic peptide
  c-term amidation

SEQ ID NO: 4218 - protein, 38 aa, Artificial Sequence; identical to SEQ ID NO: 3091
  Description of Artificial Sequence: Synthetic peptide
  n-term acetylation
  c-term amidation

SEQ ID NO: 4219 - protein, 37 aa, Artificial Sequence
  Description of Artificial Sequence: Synthetic peptide
TIINVKCKISRQCLKPCKDAGMRFGKCMAGKCHCTPK

SEQ ID NO: 4220 - protein, 37 aa, Artificial Sequence; identical to SEQ ID NO: 4219
  Description of Artificial Sequence: Synthetic peptide
  n-term acetylation

SEQ ID NO: 4221 - protein, 37 aa, Artificial Sequence; identical to SEQ ID NO: 4219
  Description of Artificial Sequence: Synthetic peptide
  c-term amidation

SEQ ID NO: 4222 - protein, 37 aa, Artificial Sequence; identical to SEQ ID NO: 4219
  Description of Artificial Sequence: Synthetic peptide
  n-term acetylation
  c-term amidation

SEQ ID NO: 4223 - protein, 38 aa, Artificial Sequence
  Description of Artificial Sequence: Synthetic peptide
GVKINVKCKISRQCLEPCKKAGMRFGKCMAGKCHCTPK

SEQ ID NO: 4224 - protein, 38 aa, Artificial Sequence; identical to SEQ ID NO: 4223
  Description of Artificial Sequence: Synthetic peptide
  n-term acetylation

SEQ ID NO: 4225 - protein, 38 aa, Artificial Sequence; identical to SEQ ID NO: 4223
  Description of Artificial Sequence: Synthetic peptide
  c-term amidation

SEQ ID NO: 4226 - protein, 38 aa, Artificial Sequence; identical to SEQ ID NO: 4223
  Description of Artificial Sequence: Synthetic peptide
  n-term acetylation
  c-term amidation

SEQ ID NO: 4227 - protein, 38 aa, Artificial Sequence
  Description of Artificial Sequence: Synthetic peptide
GVKINVKCKISRQCLEPCKKAGMRFGKCMAGKCACTPK

SEQ ID NO: 4228 - protein, 38 aa, Artificial Sequence
  Description of Artificial Sequence: Synthetic peptide
GVKINVKCKISRQCLKPCKDAGMRFGKCMAGKCHCTPK

SEQ ID NO: 4229 - protein, 38 aa, Artificial Sequence
  Description of Artificial Sequence: Synthetic peptide
GVKINVKCKISRQCLKPCKDAGMRFGKCMAGKCACTPK

SEQ ID NO: 4230 - protein, 38 aa, Artificial Sequence; identical to SEQ ID NO: 4227
  Description of Artificial Sequence: Synthetic peptide
  n-term acetylation

SEQ ID NO: 4231 - protein, 38 aa, Artificial Sequence; identical to SEQ ID NO: 4227
  Description of Artificial Sequence: Synthetic peptide
  c-term amidation

SEQ ID NO: 4232 - protein, 38 aa, Artificial Sequence; identical to SEQ ID NO: 4227
  Description of Artificial Sequence: Synthetic peptide
  n-term acetylation
  c-term amidation

SEQ ID NO: 4233 - protein, 38 aa, Artificial Sequence; identical to SEQ ID NO: 4229
  Description of Artificial Sequence: Synthetic peptide
  n-term acetylation

SEQ ID NO: 4234 - protein, 38 aa, Artificial Sequence; identical to SEQ ID NO: 4229
  Description of Artificial Sequence: Synthetic peptide
  c-term amidation

SEQ ID NO: 4235 - protein, 38 aa, Artificial Sequence; identical to SEQ ID NO: 4229
  Description of Artificial Sequence: Synthetic peptide
  n-term acetylation
  c-term amidation

SEQ ID NO: 4236 - protein, 38 aa, Artificial Sequence; identical to SEQ ID NO: 4228
  Description of Artificial Sequence: Synthetic peptide
  n-term acetylation

SEQ ID NO: 4237 - protein, 38 aa, Artificial Sequence; identical to SEQ ID NO: 4228
  Description of Artificial Sequence: Synthetic peptide
  c-term amidation

SEQ ID NO: 4238 - protein, 38 aa, Artificial Sequence; identical to SEQ ID NO: 4228
  Description of Artificial Sequence: Synthetic peptide
  n-term acetylation
  c-term amidation

SEQ ID NO: 4239 - protein, 36 aa, Artificial Sequence
  Description of Artificial Sequence: Synthetic peptide
GVIINVKCKISRQCLKPCKDAGMRFGKCMAGKCHCT

SEQ ID NO: 4240 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCHCTPK

SEQ ID NO: 4241 - protein, 38 aa, Artificial Sequence; identical to SEQ ID NO: 4240
  Description of Artificial Sequence: Synthetic peptide
  MOD_RES (16)..(16): hLys

SEQ ID NO: 4242 - protein, 38 aa, Artificial Sequence; identical to SEQ ID NO: 4240
  Description of Artificial Sequence: Synthetic peptide
  MOD_RES (16)..(16): hArg

SEQ ID NO: 4243 - protein, 38 aa, Artificial Sequence; identical to SEQ ID NO: 4240
  Description of Artificial Sequence: Synthetic peptide
  MOD_RES (16)..(16): Cit

SEQ ID NO: 4244 - protein, 38 aa, Artificial Sequence; identical to SEQ ID NO: 4240
  Description of Artificial Sequence: Synthetic peptide
  MOD_RES (16)..(16): hCit

SEQ ID NO: 4245 - protein, 38 aa, Artificial Sequence; identical to SEQ ID NO: 4240
  Description of Artificial Sequence: Synthetic peptide
  MOD_RES (16)..(16): Dpr

SEQ ID NO: 4246 - protein, 38 aa, Artificial Sequence; identical to SEQ ID NO: 4240
  Description of Artificial Sequence: Synthetic peptide
  MOD_RES (16)..(16): Dab

SEQ ID NO: 4247 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCHCYPK

SEQ ID NO: 4248 - protein, 38 aa, Artificial Sequence; identical to SEQ ID NO: 4247
  Description of Artificial Sequence: Synthetic peptide
  MOD_RES (16)..(16): hLys

SEQ ID NO: 4249 - protein, 38 aa, Artificial Sequence; identical to SEQ ID NO: 4247
  Description of Artificial Sequence: Synthetic peptide
  MOD_RES (16)..(16): hArg

SEQ ID NO: 4250 - protein, 38 aa, Artificial Sequence; identical to SEQ ID NO: 4247
  Description of Artificial Sequence: Synthetic peptide
  MOD_RES (16)..(16): Cit

SEQ ID NO: 4251 - protein, 38 aa, Artificial Sequence; identical to SEQ ID NO: 4247
  Description of Artificial Sequence: Synthetic peptide
  MOD_RES (16)..(16): hCit

SEQ ID NO: 4252 - protein, 38 aa, Artificial Sequence; identical to SEQ ID NO: 4247
  Description of Artificial Sequence: Synthetic peptide
  MOD_RES (16)..(16): Dpr

SEQ ID NO: 4253 - protein, 38 aa, Artificial Sequence; identical to SEQ ID NO: 4247
  Description of Artificial Sequence: Synthetic peptide
  MOD_RES (16)..(16): Dab

SEQ ID NO: 4254 - protein, 38 aa, Artificial Sequence
  Description of Artificial Sequence: Synthetic peptide
GVIINVKCKISRQCLKPCKDAGMRFGKCMAGKCACYPK

SEQ ID NO: 4255 - protein, 38 aa, Artificial Sequence
  Description of Artificial Sequence: Synthetic peptide
GVIINVKCKISRQCLKPCKDAGMRFGKCMAGKCGCYPK

SEQ ID NO: 4256 - protein, 38 aa, Artificial Sequence
  Description of Artificial Sequence: Synthetic peptide
GVIINVKCKISRQCLKPCKDAGMRFGKCMAGKCACFPK

SEQ ID NO: 4257 - protein, 38 aa, Artificial Sequence
  Description of Artificial Sequence: Synthetic peptide
GVIINVKCKISRQCLKPCKDAGMRFGKCMAGKCACWPK

SEQ ID NO: 4258 - protein, 38 aa, Artificial Sequence
  Description of Artificial Sequence: Synthetic peptide
GVIINVKCKISRQCLKPCKEAGMRFGKCMAGKCACYPK

SEQ ID NO: 4259 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCACTPK

SEQ ID NO: 4260 - protein, 38 aa, Artificial Sequence; identical to SEQ ID NO: 4259
  Description of Artificial Sequence: Synthetic peptide
  MOD_RES (16)..(16): hLys

SEQ ID NO: 4261 - protein, 38 aa, Artificial Sequence; identical to SEQ ID NO: 4259
  Description of Artificial Sequence: Synthetic peptide
  MOD_RES (16)..(16): hArg

SEQ ID NO: 4262 - protein, 38 aa, Artificial Sequence; identical to SEQ ID NO: 4259
  Description of Artificial Sequence: Synthetic peptide
  MOD_RES (16)..(16): Cit

SEQ ID NO: 4263 - protein, 38 aa, Artificial Sequence; identical to SEQ ID NO: 4240
  Description of Artificial Sequence: Synthetic peptide
  MOD_RES (16)..(16): hCit

SEQ ID NO: 4264 - protein, 38 aa, Artificial Sequence; identical to SEQ ID NO: 4259
  Description of Artificial Sequence: Synthetic peptide
  MOD_RES (16)..(16): Dpr

SEQ ID NO: 4265 - protein, 38 aa, Artificial Sequence; identical to SEQ ID NO: 4259
  Description of Artificial Sequence: Synthetic peptide
  MOD_RES (16)..(16): Dab

SEQ ID NO: 4266 - protein, 35 aa, Artificial Sequence
  Description of Artificial Sequence: Synthetic peptide
  MOD_RES (16)..(16): Orn
GVIINVKCKISRQCLXPCKDAGMRFGKCMAGKCHC

SEQ ID NO: 4267 - protein, 35 aa, Artificial Sequence; identical to SEQ ID NO: 4266
  Description of Artificial Sequence: Synthetic peptide
  MOD_RES (16)..(16): hLys

SEQ ID NO: 4268 - protein, 35 aa, Artificial Sequence; identical to SEQ ID NO: 4266
  Description of Artificial Sequence: Synthetic peptide
  MOD_RES (16)..(16): hArg

SEQ ID NO: 4269 - protein, 35 aa, Artificial Sequence; identical to SEQ ID NO: 4266
  Description of Artificial Sequence: Synthetic peptide
  MOD_RES (16)..(16): Cit

SEQ ID NO: 4270 - protein, 35 aa, Artificial Sequence; identical to SEQ ID NO: 4266
  Description of Artificial Sequence: Synthetic peptide
  MOD_RES (16)..(16): hCit

SEQ ID NO: 4271 - protein, 35 aa, Artificial Sequence; identical to SEQ ID NO: 4266
  Description of Artificial Sequence: Synthetic peptide
  MOD_RES (16)..(16): Dpr

SEQ ID NO: 4272 - protein, 35 aa, Artificial Sequence; identical to SEQ ID NO: 4266
  Description of Artificial Sequence: Synthetic peptide
  MOD_RES (16)..(16): Dab

SEQ ID NO: 4273 - protein, 35 aa, Artificial Sequence
  Description of Artificial Sequence: Synthetic peptide
  MOD_RES (16)..(16): Orn
GVIINVKCKISRQCLXPCKDAGMRFGKCMAGKCAC

SEQ ID NO: 4274 - protein, 35 aa, Artificial Sequence; identical to SEQ ID NO: 4273
  Description of Artificial Sequence: Synthetic peptide
  MOD_RES (16)..(16): hLys

SEQ ID NO: 4275 - protein, 35 aa, Artificial Sequence; identical to SEQ ID NO: 4273
  Description of Artificial Sequence: Synthetic peptide
  MOD_RES (16)..(16): hArg

SEQ ID NO: 4276 - protein, 35 aa, Artificial Sequence; identical to SEQ ID NO: 4273
  Description of Artificial Sequence: Synthetic peptide
  MOD_RES (16)..(16): Cit

SEQ ID NO: 4277 - protein, 35 aa, Artificial Sequence; identical to SEQ ID NO: 4266
  Description of Artificial Sequence: Synthetic peptide
  MOD_RES (16)..(16): hCit

SEQ ID NO: 4278 - protein, 35 aa, Artificial Sequence; identical to SEQ ID NO: 4273
  Description of Artificial Sequence: Synthetic peptide
  MOD_RES (16)..(16): Dpr

SEQ ID NO: 4279 - protein, 35 aa, Artificial Sequence; identical to SEQ ID NO: 4273
  Description of Artificial Sequence: Synthetic peptide
  MOD_RES (16)..(16): Dab

SEQ ID NO: 4280 - protein, 38 aa, Artificial Sequence
  Description of Artificial Sequence: Synthetic peptide
GVIINVKCKISRQCLKPCKDAGMRFGKCMAGKCGCYGG

SEQ ID NO: 4281 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCHCYGG

SEQ ID NO: 4282 - protein, 38 aa, Artificial Sequence; identical to SEQ ID NO: 4281
  Description of Artificial Sequence: Synthetic peptide
  MOD_RES (16)..(16): hLys

SEQ ID NO: 4283 - protein, 38 aa, Artificial Sequence; identical to SEQ ID NO: 4281
  Description of Artificial Sequence: Synthetic peptide
  MOD_RES (16)..(16): hArg

SEQ ID NO: 4284 - protein, 38 aa, Artificial Sequence; identical to SEQ ID NO: 4281
  Description of Artificial Sequence: Synthetic peptide
  MOD_RES (16)..(16): Cit

SEQ ID NO: 4285 - protein, 38 aa, Artificial Sequence; identical to SEQ ID NO: 4281
  Description of Artificial Sequence: Synthetic peptide
  MOD_RES (16)..(16): hCit

SEQ ID NO: 4286 - protein, 38 aa, Artificial Sequence; identical to SEQ ID NO: 4281
  Description of Artificial Sequence: Synthetic peptide
  MOD_RES (16)..(16): Dpr

SEQ ID NO: 4287 - protein, 38 aa, Artificial Sequence
  Description of Artificial Sequence: Synthetic peptide
GVIINVKCKISRQCLKPCKDAGMRFGKCMAGKCACYGG

SEQ ID NO: 4288 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCACYGG

SEQ ID NO: 4289 - protein, 38 aa, Artificial Sequence; identical to SEQ ID NO: 4288
  Description of Artificial Sequence: Synthetic peptide
  MOD_RES (16)..(16): hLys

SEQ ID NO: 4290 - protein, 38 aa, Artificial Sequence; identical to SEQ ID NO: 4288
  Description of Artificial Sequence: Synthetic peptide
  MOD_RES (16)..(16): hArg

SEQ ID NO: 4291 - protein, 38 aa, Artificial Sequence; identical to SEQ ID NO: 4288
  Description of Artificial Sequence: Synthetic peptide
  MOD_RES (16)..(16): Cit

SEQ ID NO: 4292 - protein, 38 aa, Artificial Sequence; identical to SEQ ID NO: 4281
  Description of Artificial Sequence: Synthetic peptide
  MOD_RES (16)..(16): hCit

SEQ ID NO: 4293 - protein, 38 aa, Artificial Sequence; identical to SEQ ID NO: 4288
  Description of Artificial Sequence: Synthetic peptide
  MOD_RES (16)..(16): Dpr

SEQ ID NO: 4294 - protein, 38 aa, Artificial Sequence; identical to SEQ ID NO: 4288
  Description of Artificial Sequence: Synthetic peptide
  MOD_RES (16)..(16): Dab

SEQ ID NO: 4295 - protein, 37 aa, Artificial Sequence
  Description of Artificial Sequence: Synthetic peptide
GVIINVKCKISRQCLKPCKDAGMRFGKCMAGKCACYG

SEQ ID NO: 4296 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCHCGGG

SEQ ID NO: 4297 - protein, 38 aa, Artificial Sequence; identical to SEQ ID NO: 4296
  Description of Artificial Sequence: Synthetic peptide
  MOD_RES (16)..(16): hLys

SEQ ID NO: 4298 - protein, 38 aa, Artificial Sequence; identical to SEQ ID NO: 4296
  Description of Artificial Sequence: Synthetic peptide
  MOD_RES (16)..(16): hArg

SEQ ID NO: 4299 - protein, 38 aa, Artificial Sequence; identical to SEQ ID NO: 4296
  Description of Artificial Sequence: Synthetic peptide
  MOD_RES (16)..(16): Cit

SEQ ID NO: 4300 - protein, 38 aa, Artificial Sequence; identical to SEQ ID NO: 4296
  Description of Artificial Sequence: Synthetic peptide
  MOD_RES (16)..(16): hCit

SEQ ID NO: 4301 - protein, 38 aa, Artificial Sequence; identical to SEQ ID NO: 4296
  Description of Artificial Sequence: Synthetic peptide
  MOD_RES (16)..(16): Dpr

SEQ ID NO: 4302 - protein, 38 aa, Artificial Sequence
  Description of Artificial Sequence: Synthetic peptide
GVIINVKCKISRQCLKPCKDAGMRFGKCMAGKCACFGG

SEQ ID NO: 4303 - protein, 38 aa, Artificial Sequence
  Description of Artificial Sequence: Synthetic peptide
  MOD_RES (16)..(16): Orn
GVIINVKCKISRQCLXPCKDAGMRFGKCMAGKCACGGG

SEQ ID NO: 4304 - protein, 38 aa, Artificial Sequence; identical to SEQ ID NO: 4303
  Description of Artificial Sequence: Synthetic peptide
  MOD_RES (16)..(16): hLys

SEQ ID NO: 4305 - protein, 38 aa, Artificial Sequence; identical to SEQ ID NO: 4303
  Description of Artificial Sequence: Synthetic peptide
  MOD_RES (16)..(16): hArg

SEQ ID NO: 4306 - protein, 38 aa, Artificial Sequence; identical to SEQ ID NO: 4303
  Description of Artificial Sequence: Synthetic peptide
  MOD_RES (16)..(16): Cit

SEQ ID NO: 4307 - protein, 38 aa, Artificial Sequence; identical to SEQ ID NO: 4303
  Description of Artificial Sequence: Synthetic peptide
  MOD_RES (16)..(16): hCit

SEQ ID NO: 4308 - protein, 38 aa, Artificial Sequence; identical to SEQ ID NO: 4303
  Description of Artificial Sequence: Synthetic peptide
  MOD_RES (16)..(16): Dpr

SEQ ID NO: 4309 - protein, 38 aa, Artificial Sequence; identical to SEQ ID NO: 4303
  Description of Artificial Sequence: Synthetic peptide
  MOD_RES (16)..(16): Dab

SEQ ID NO: 4310 - protein, 37 aa, Artificial Sequence
  Description of Artificial Sequence: Synthetic peptide
GVIINVKCKISRQCLKPCKDAGMRFGKCMAGKCACGG

SEQ ID NO: 4311 - protein, 37 aa, Artificial Sequence; identical to SEQ ID NO: 4295
  Description of Artificial Sequence: Synthetic peptide

SEQ ID NO: 4312 - protein, 37 aa, Artificial Sequence
  Description of Artificial Sequence: Synthetic peptide
  MOD_RES (16)..(16): Orn
GVIINVKCKISRQCLXPCKDAGMRFGKCMAGKCACGG

SEQ ID NO: 4313 - protein, 38 aa, Artificial Sequence
  Description of Artificial Sequence: Synthetic peptide
  MOD_RES (16)..(16): hLys
GVIINVKCKISRQCLXPCKEAGMRFGKCMAGKCHCTPK

SEQ ID NO: 4314 - protein, 38 aa, Artificial Sequence; identical to SEQ ID NO: 4313
  Description of Artificial Sequence: Synthetic peptide
  MOD_RES (16)..(16): hArg

SEQ ID NO: 4315 - protein, 38 aa, Artificial Sequence; identical to SEQ ID NO: 4313
  Description of Artificial Sequence: Synthetic peptide
  MOD_RES (16)..(16): Cit

SEQ ID NO: 4316 - protein, 38 aa, Artificial Sequence; identical to SEQ ID NO: 4313
  Description of Artificial Sequence: Synthetic peptide
  MOD_RES (16)..(16): hCit

SEQ ID NO: 4317 - protein, 38 aa, Artificial Sequence; identical to SEQ ID NO: 4313
  Description of Artificial Sequence: Synthetic peptide
  MOD_RES (16)..(16): Dpr

SEQ ID NO: 4318 - protein, 38 aa, Artificial Sequence; identical to SEQ ID NO: 4313
  Description of Artificial Sequence: Synthetic peptide
  MOD_RES (16)..(16): Dab

SEQ ID NO: 4319 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCHCYPK

SEQ ID NO: 4320 - protein, 38 aa, Artificial Sequence; identical to SEQ ID NO: 4319
  Description of Artificial Sequence: Synthetic peptide
  MOD_RES (16)..(16): hLys

SEQ ID NO: 4321 - protein, 38 aa, Artificial Sequence; identical to SEQ ID NO: 4319
  Description of Artificial Sequence: Synthetic peptide
  MOD_RES (16)..(16): hArg

SEQ ID NO: 4322 - protein, 38 aa, Artificial Sequence; identical to SEQ ID NO: 4319
  Description of Artificial Sequence: Synthetic peptide
  MOD_RES (16)..(16): Cit

SEQ ID NO: 4323 - protein, 38 aa, Artificial Sequence; identical to SEQ ID NO: 4319
  Description of Artificial Sequence: Synthetic peptide
  MOD_RES (16)..(16): hCit

SEQ ID NO: 4324 - protein, 38 aa, Artificial Sequence; identical to SEQ ID NO: 4319
  Description of Artificial Sequence: Synthetic peptide
  MOD_RES (16)..(16): Dpr

SEQ ID NO: 4325 - protein, 38 aa, Artificial Sequence; identical to SEQ ID NO: 4319
  Description of Artificial Sequence: Synthetic peptide
  MOD_RES (16)..(16): Dab

SEQ ID NO: 4326 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCACTPK

SEQ ID NO: 4327 - protein, 38 aa, Artificial Sequence; identical to SEQ ID NO: 4326
  Description of Artificial Sequence: Synthetic peptide
  MOD_RES (16)..(16): hLys

SEQ ID NO: 4328 - protein, 38 aa, Artificial Sequence; identical to SEQ ID NO: 4326
  Description of Artificial Sequence: Synthetic peptide
  MOD_RES (16)..(16): hArg

SEQ ID NO: 4329 - protein, 38 aa, Artificial Sequence; identical to SEQ ID NO: 4326
  Description of Artificial Sequence: Synthetic peptide
  MOD_RES (16)..(16): Cit

SEQ ID NO: 4330 - protein, 38 aa, Artificial Sequence; identical to SEQ ID NO: 4313
  Description of Artificial Sequence: Synthetic peptide
  MOD_RES (16)..(16): hCit

SEQ ID NO: 4331 - protein, 38 aa, Artificial Sequence; identical to SEQ ID NO: 4326
  Description of Artificial Sequence: Synthetic peptide
  MOD_RES (16)..(16): Dpr

SEQ ID NO: 4332 - protein, 38 aa, Artificial Sequence; identical to SEQ ID NO: 4326
  Description of Artificial Sequence: Synthetic peptide
  MOD_RES (16)..(16): Dab

SEQ ID NO: 4333 - protein, 35 aa, Artificial Sequence
  Description of Artificial Sequence: Synthetic peptide
  MOD_RES (16)..(16): Orn
GVIINVKCKISRQCLXPCKEAGMRFGKCMAGKCHC

SEQ ID NO: 4334 - protein, 35 aa, Artificial Sequence; identical to SEQ ID NO: 4333
  Description of Artificial Sequence: Synthetic peptide
  MOD_RES (16)..(16): hLys

SEQ ID NO: 4335 - protein, 35 aa, Artificial Sequence; identical to SEQ ID NO: 4333
  Description of Artificial Sequence: Synthetic peptide
  MOD_RES (16)..(16): hArg

SEQ ID NO: 4336 - protein, 35 aa, Artificial Sequence; identical to SEQ ID NO: 4333
  Description of Artificial Sequence: Synthetic peptide
  MOD_RES (16)..(16): Cit

SEQ ID NO: 4337 - protein, 35 aa, Artificial Sequence; identical to SEQ ID NO: 4333
  Description of Artificial Sequence: Synthetic peptide
  MOD_RES (16)..(16): hCit

SEQ ID NO: 4338 - protein, 35 aa, Artificial Sequence; identical to SEQ ID NO: 4333
  Description of Artificial Sequence: Synthetic peptide
  MOD_RES (16)..(16): Dpr

SEQ ID NO: 4339 - protein, 35 aa, Artificial Sequence
  Description of Artificial Sequence: Synthetic peptide
  MOD_RES (16)..(16): Orn
GVIINVKCKISRQCLXPCKEAGMRFGKCMAGKCAC

SEQ ID NO: 4340 - protein, 35 aa, Artificial Sequence; identical to SEQ ID NO: 4339
  Description of Artificial Sequence: Synthetic peptide
  MOD_RES (16)..(16): hLys

SEQ ID NO: 4341 - protein, 35 aa, Artificial Sequence; identical to SEQ ID NO: 4339
  Description of Artificial Sequence: Synthetic peptide
  MOD_RES (16)..(16): hArg

SEQ ID NO: 4342 - protein, 35 aa, Artificial Sequence; identical to SEQ ID NO: 4339
  Description of Artificial Sequence: Synthetic peptide
  MOD_RES (16)..(16): Cit

SEQ ID NO: 4343 - protein, 35 aa, Artificial Sequence; identical to SEQ ID NO: 4333
  Description of Artificial Sequence: Synthetic peptide
  MOD_RES (16)..(16): hCit

SEQ ID NO: 4344 - protein, 35 aa, Artificial Sequence; identical to SEQ ID NO: 4339
  Description of Artificial Sequence: Synthetic peptide
  MOD_RES (16)..(16): Dpr

SEQ ID NO: 4345 - protein, 35 aa, Artificial Sequence; identical to SEQ ID NO: 4339
  Description of Artificial Sequence: Synthetic peptide
  MOD_RES (16)..(16): Dab

SEQ ID NO: 4346 - protein, 38 aa, Artificial Sequence
  Description of Artificial Sequence: Synthetic peptide
GVIINVKCKISRQCLKPCKEAGMRFGKCMAGKCHCYGG

SEQ ID NO: 4347 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCHCYGG

SEQ ID NO: 4348 - protein, 37 aa, Artificial Sequence
  Description of Artificial Sequence: Synthetic peptide
GVIINVKCKISRQCLKPCKEAGMRFGKCMAGKCHCYG

SEQ ID NO: 4349 - protein, 37 aa, Artificial Sequence
  Description of Artificial Sequence: Synthetic peptide
GVIINVKCKISRQCLKPCKEAGMRFGKCMAGKCACYG

SEQ ID NO: 4350 - protein, 38 aa, Artificial Sequence; identical to SEQ ID NO: 4347
  Description of Artificial Sequence: Synthetic peptide
  MOD_RES (16)..(16): hLys

SEQ ID NO: 4351 - protein, 38 aa, Artificial Sequence; identical to SEQ ID NO: 4347
  Description of Artificial Sequence: Synthetic peptide
  MOD_RES (16)..(16): hArg

SEQ ID NO: 4352 - protein, 38 aa, Artificial Sequence; identical to SEQ ID NO: 4347
  Description of Artificial Sequence: Synthetic peptide
  MOD_RES (16)..(16): Cit

SEQ ID NO: 4353 - protein, 38 aa, Artificial Sequence; identical to SEQ ID NO: 4347
  Description of Artificial Sequence: Synthetic peptide
  MOD_RES (16)..(16): hCit

SEQ ID NO: 4354 - protein, 38 aa, Artificial Sequence; identical to SEQ ID NO: 4347
  Description of Artificial Sequence: Synthetic peptide
  MOD_RES (16)..(16): Dpr

SEQ ID NO: 4355 - protein, 38 aa, Artificial Sequence; identical to SEQ ID NO: 4347
  Description of Artificial Sequence: Synthetic peptide
  MOD_RES (16)..(16): Dab

SEQ ID NO: 4356 - protein, 37 aa, Artificial Sequence; identical to SEQ ID NO: 4349
  Description of Artificial Sequence: Synthetic peptide

SEQ ID NO: 4357 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCACYGG

SEQ ID NO: 4358 - protein, 38 aa, Artificial Sequence; identical to SEQ ID NO: 4357
  Description of Artificial Sequence: Synthetic peptide
  MOD_RES (16)..(16): hLys

SEQ ID NO: 4359 - protein, 38 aa, Artificial Sequence; identical to SEQ ID NO: 4357
  Description of Artificial Sequence: Synthetic peptide
  MOD_RES (16)..(16): hArg

SEQ ID NO: 4360 - protein, 38 aa, Artificial Sequence; identical to SEQ ID NO: 4357
  Description of Artificial Sequence: Synthetic peptide
  MOD_RES (16)..(16): Cit

SEQ ID NO: 4361 - protein, 38 aa, Artificial Sequence; identical to SEQ ID NO: 4347
  Description of Artificial Sequence: Synthetic peptide
  MOD_RES (16)..(16): hCit

SEQ ID NO: 4362 - protein, 38 aa, Artificial Sequence; identical to SEQ ID NO: 4357
  Description of Artificial Sequence: Synthetic peptide
  MOD_RES (16)..(16): Dpr

SEQ ID NO: 4363 - protein, 38 aa, Artificial Sequence; identical to SEQ ID NO: 4357
  Description of Artificial Sequence: Synthetic peptide
  MOD_RES (16)..(16): Dab

SEQ ID NO: 4364 - protein, 38 aa, Artificial Sequence
  Description of Artificial Sequence: Synthetic peptide
GVIINVKCKISRQCLKPCKEAGMRFGKCMAGKCACFGG

SEQ ID NO: 4365 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCHCGGG

SEQ ID NO: 4366 - protein, 38 aa, Artificial Sequence; identical to SEQ ID NO: 4365
  Description of Artificial Sequence: Synthetic peptide
  MOD_RES (16)..(16): hLys

SEQ ID NO: 4367 - protein, 38 aa, Artificial Sequence; identical to SEQ ID NO: 4365
  Description of Artificial Sequence: Synthetic peptide
  MOD_RES (16)..(16): hArg

SEQ ID NO: 4368 - protein, 38 aa, Artificial Sequence; identical to SEQ ID NO: 4365
  Description of Artificial Sequence: Synthetic peptide
  MOD_RES (16)..(16): Cit

SEQ ID NO: 4369 - protein, 38 aa, Artificial Sequence; identical to SEQ ID NO: 4365
  Description of Artificial Sequence: Synthetic peptide
  MOD_RES (16)..(16): hCit

SEQ ID NO: 4370 - protein, 38 aa, Artificial Sequence; identical to SEQ ID NO: 4365
  Description of Artificial Sequence: Synthetic peptide
  MOD_RES (16)..(16): Dpr

SEQ ID NO: 4371 - protein, 38 aa, Artificial Sequence
  Description of Artificial Sequence: Synthetic peptide
  MOD_RES (16)..(16): Orn
GVIINVKCKISRQCLXPCKEAGMRFGKCMAGKCACGGG

SEQ ID NO: 4372 - protein, 38 aa, Artificial Sequence; identical to SEQ ID NO: 4371
  Description of Artificial Sequence: Synthetic peptide
  MOD_RES (16)..(16): hLys

SEQ ID NO: 4373 - protein, 38 aa, Artificial Sequence; identical to SEQ ID NO: 4371
  Description of Artificial Sequence: Synthetic peptide
  MOD_RES (16)..(16): hArg

SEQ ID NO: 4374 - protein, 38 aa, Artificial Sequence; identical to SEQ ID NO: 4371
  Description of Artificial Sequence: Synthetic peptide
  MOD_RES (16)..(16): Cit

SEQ ID NO: 4375 - protein, 37 aa, Artificial Sequence
  Description of Artificial Sequence: Synthetic peptide
  MOD_RES (16)..(16): hCit
GVIINVKCKISRQCLXPCKEAGMRFGKCMAGKCACTP

SEQ ID NO: 4376 - protein, 37 aa, Artificial Sequence; identical to SEQ ID NO: 4375
  Description of Artificial Sequence: Synthetic peptide
  MOD_RES (16)..(16): Dpr

SEQ ID NO: 4377 - protein, 37 aa, Artificial Sequence; identical to SEQ ID NO: 4375
  Description of Artificial Sequence: Synthetic peptide
  MOD_RES (16)..(16): Dab

SEQ ID NO: 4378 - protein, 38 aa, Artificial Sequence; identical to SEQ ID NO: 4240
  Description of Artificial Sequence: Synthetic peptide
  MOD_RES (16)..(16): Orn
  c-term amidation

SEQ ID NO: 4379 - protein, 38 aa, Artificial Sequence; identical to SEQ ID NO: 4240
  Description of Artificial Sequence: Synthetic peptide
  MOD_RES (16)..(16): hLys
  c-term amidation

SEQ ID NO: 4380 - protein, 38 aa, Artificial Sequence; identical to SEQ ID NO: 4240
  Description of Artificial Sequence: Synthetic peptide
  MOD_RES (16)..(16): hArg
  c-term amidation

SEQ ID NO: 4381 - protein, 38 aa, Artificial Sequence; identical to SEQ ID NO: 4240
  Description of Artificial Sequence: Synthetic peptide
  MOD_RES (16)..(16): Cit
  c-term amidation

SEQ ID NO: 4382 - protein, 38 aa, Artificial Sequence; identical to SEQ ID NO: 4240
  Description of Artificial Sequence: Synthetic peptide
  MOD_RES (16)..(16): hCit
  c-term amidation

SEQ ID NO: 4383 - protein, 38 aa, Artificial Sequence; identical to SEQ ID NO: 4240
  Description of Artificial Sequence: Synthetic peptide
  MOD_RES (16)..(16): Dpr
  c-term amidation

SEQ ID NO: 4384 - protein, 38 aa, Artificial Sequence; identical to SEQ ID NO: 4240
  Description of Artificial Sequence: Synthetic peptide
  MOD_RES (16)..(16): Dab
  c-term amidation

SEQ ID NO: 4385 - protein, 38 aa, Artificial Sequence; identical to SEQ ID NO: 4247
  Description of Artificial Sequence: Synthetic peptide
  MOD_RES (16)..(16): Orn
  c-term amidation

SEQ ID NO: 4386 - protein, 38 aa, Artificial Sequence; identical to SEQ ID NO: 4247
  Description of Artificial Sequence: Synthetic peptide
  MOD_RES (16)..(16): hLys
  c-term amidation

SEQ ID NO: 4387 - protein, 38 aa, Artificial Sequence; identical to SEQ ID NO: 4247
  Description of Artificial Sequence: Synthetic peptide
  MOD_RES (16)..(16): hArg
  c-term amidation

SEQ ID NO: 4388 - protein, 38 aa, Artificial Sequence; identical to SEQ ID NO: 4247
  Description of Artificial Sequence: Synthetic peptide
  MOD_RES (16)..(16): Cit
  c-term amidation

SEQ ID NO: 4389 - protein, 38 aa, Artificial Sequence; identical to SEQ ID NO: 4247
  Description of Artificial Sequence: Synthetic peptide
  MOD_RES (16)..(16): hCit
  c-term amidation

SEQ ID NO: 4390 - protein, 38 aa, Artificial Sequence; identical to SEQ ID NO: 4247
  Description of Artificial Sequence: Synthetic peptide
  MOD_RES (16)..(16): Dpr
  c-term amidation

SEQ ID NO: 4391 - protein, 38 aa, Artificial Sequence; identical to SEQ ID NO: 4247
  Description of Artificial Sequence: Synthetic peptide
  MOD_RES (16)..(16): Dab
  c-term amidation

SEQ ID NO: 4392 - protein, 38 aa, Artificial Sequence; identical to SEQ ID NO: 4259
  Description of Artificial Sequence: Synthetic peptide
  MOD_RES (16)..(16): Orn
  c-term amidation

SEQ ID NO: 4393 - protein, 38 aa, Artificial Sequence; identical to SEQ ID NO: 4259
  Description of Artificial Sequence: Synthetic peptide
  MOD_RES (16)..(16): hLys
  c-term amidation

SEQ ID NO: 4394 - protein, 38 aa, Artificial Sequence; identical to SEQ ID NO: 4259
  Description of Artificial Sequence: Synthetic peptide
  MOD_RES (16)..(16): hArg
  c-term amidation

SEQ ID NO: 4395 - protein, 38 aa, Artificial Sequence; identical to SEQ ID NO: 4259
  Description of Artificial Sequence: Synthetic peptide
  MOD_RES (16)..(16): Cit
  c-term amidation

SEQ ID NO: 4396 - protein, 38 aa, Artificial Sequence; identical to SEQ ID NO: 4259
  Description of Artificial Sequence: Synthetic peptide
  MOD_RES (16)..(16): hCit
  c-term amidation

SEQ ID NO: 4397 - protein, 38 aa, Artificial Sequence; identical to SEQ ID NO: 4259
  Description of Artificial Sequence: Synthetic peptide
  MOD_RES (16)..(16): Dpr
  c-term amidation

SEQ ID NO: 4398 - protein, 38 aa, Artificial Sequence; identical to SEQ ID NO: 4259
  Description of Artificial Sequence: Synthetic peptide
  MOD_RES (16)..(16): Dab
  c-term amidation

SEQ ID NO: 4399 - protein, 35 aa, Artificial Sequence; identical to SEQ ID NO: 4266
  Description of Artificial Sequence: Synthetic peptide
  MOD_RES (16)..(16): Orn
  c-term amidation

SEQ ID NO: 4400 - protein, 35 aa, Artificial Sequence; identical to SEQ ID NO: 4266
  Description of Artificial Sequence: Synthetic peptide
  MOD_RES (16)..(16): hLys
  c-term amidation

SEQ ID NO: 4401 - protein, 35 aa, Artificial Sequence; identical to SEQ ID NO: 4266
  Description of Artificial Sequence: Synthetic peptide
  MOD_RES (16)..(16): hArg
  c-term amidation

SEQ ID NO: 4402 - protein, 35 aa, Artificial Sequence; identical to SEQ ID NO: 4266
  Description of Artificial Sequence: Synthetic peptide
  MOD_RES (16)..(16): Cit
  c-term amidation

SEQ ID NO: 4403 - protein, 35 aa, Artificial Sequence; identical to SEQ ID NO: 4266
  Description of Artificial Sequence: Synthetic peptide
  MOD_RES (16)..(16): hCit
  c-term amidation

SEQ ID NO: 4404 - protein, 35 aa, Artificial Sequence; identical to SEQ ID NO: 4266
  Description of Artificial Sequence: Synthetic peptide
  MOD_RES (16)..(16): Dpr
  c-term amidation

SEQ ID NO: 4405 - protein, 33 aa, Artificial Sequence
  Description of Artificial Sequence: Synthetic peptide
  MOD_RES (16)..(16): Orn
  c-term amidation
GVIINVKCKISRQCLXPCKDAGMRFGKCMAGKC

SEQ ID NO: 4406 - protein, 33 aa, Artificial Sequence; identical to SEQ ID NO: 4405
  Description of Artificial Sequence: Synthetic peptide
  MOD_RES (16)..(16): hLys
  c-term amidation

SEQ ID NO: 4407 - protein, 33 aa, Artificial Sequence; identical to SEQ ID NO: 4405
  Description of Artificial Sequence: Synthetic peptide
  MOD_RES (16)..(16): hArg
  c-term amidation

SEQ ID NO: 4408 - protein, 33 aa, Artificial Sequence; identical to SEQ ID NO: 4405
  Description of Artificial Sequence: Synthetic peptide
  MOD_RES (16)..(16): Cit
  c-term amidation

SEQ ID NO: 4409 - protein, 35 aa, Artificial Sequence; identical to SEQ ID NO: 4266
  Description of Artificial Sequence: Synthetic peptide
  MOD_RES (16)..(16): hCit
  c-term amidation

SEQ ID NO: 4410 - protein, 33 aa, Artificial Sequence; identical to SEQ ID NO: 4405
  Description of Artificial Sequence: Synthetic peptide
  MOD_RES (16)..(16): Dpr
  c-term amidation

SEQ ID NO: 4411 - protein, 33 aa, Artificial Sequence; identical to SEQ ID NO: 4405
  Description of Artificial Sequence: Synthetic peptide
  MOD_RES (16)..(16): Dab
  c-term amidation

SEQ ID NO: 4412 - protein, 38 aa, Artificial Sequence
  Description of Artificial Sequence: Synthetic peptide
  c-term amidation
GVIINVKCKISRQCLKPCKDAGMRFGKCMAGKCHCYGG

SEQ ID NO: 4413 - protein, 38 aa, Artificial Sequence; identical to SEQ ID NO: 4281
  Description of Artificial Sequence: Synthetic peptide
  MOD_RES (16)..(16): Orn
  c-term amidation

SEQ ID NO: 4414 - protein, 38 aa, Artificial Sequence; identical to SEQ ID NO: 4281
  Description of Artificial Sequence: Synthetic peptide
  MOD_RES (16)..(16): hLys
  c-term amidation

SEQ ID NO: 4415 - protein, 38 aa, Artificial Sequence; identical to SEQ ID NO: 4281
  Description of Artificial Sequence: Synthetic peptide
  MOD_RES (16)..(16): hArg
  c-term amidation

SEQ ID NO: 4416 - protein, 38 aa, Artificial Sequence; identical to SEQ ID NO: 4281
  Description of Artificial Sequence: Synthetic peptide
  MOD_RES (16)..(16): Cit
  c-term amidation

SEQ ID NO: 4417 - protein, 38 aa, Artificial Sequence; identical to SEQ ID NO: 4281
  Description of Artificial Sequence: Synthetic peptide
  MOD_RES (16)..(16): hCit
  c-term amidation

SEQ ID NO: 4418 - protein, 38 aa, Artificial Sequence; identical to SEQ ID NO: 4281
  Description of Artificial Sequence: Synthetic peptide
  MOD_RES (16)..(16): Dpr
  c-term amidation

SEQ ID NO: 4419 - protein, 38 aa, Artificial Sequence
  Description of Artificial Sequence: Synthetic peptide
  c-term amidation
GVIINVKCKISRQCLKPCKDAGMRFGKCMAGKCHCFGG

SEQ ID NO: 4420 - protein, 37 aa, Artificial Sequence
  Description of Artificial Sequence: Synthetic peptide
  c-term amidation
GVIINVKCKISRQCLKPCKDAGMRFGKCMAGKCHCYG

SEQ ID NO: 4421 - protein, 37 aa, Artificial Sequence; identical to SEQ ID NO: 4295
  Description of Artificial Sequence: Synthetic peptide
  c-term amidation

SEQ ID NO: 4422 - protein, 38 aa, Artificial Sequence; identical to SEQ ID NO: 4288
  Description of Artificial Sequence: Synthetic peptide
  MOD_RES (16)..(16): Orn
  c-term amidation

SEQ ID NO: 4423 - protein, 38 aa, Artificial Sequence; identical to SEQ ID NO: 4288
  Description of Artificial Sequence: Synthetic peptide
  MOD_RES (16)..(16): hLys
  c-term amidation

SEQ ID NO: 4424 - protein, 38 aa, Artificial Sequence; identical to SEQ ID NO: 4288
  Description of Artificial Sequence: Synthetic peptide
  MOD_RES (16)..(16): hArg
  c-term amidation

SEQ ID NO: 4425 - protein, 38 aa, Artificial Sequence; identical to SEQ ID NO: 4288
  Description of Artificial Sequence: Synthetic peptide
  MOD_RES (16)..(16): Cit
  c-term amidation

SEQ ID NO: 4426 - protein, 38 aa, Artificial Sequence; identical to SEQ ID NO: 4288
  Description of Artificial Sequence: Synthetic peptide
  MOD_RES (16)..(16): hCit
  c-term amidation

SEQ ID NO: 4427 - protein, 38 aa, Artificial Sequence; identical to SEQ ID NO: 4288
  Description of Artificial Sequence: Synthetic peptide
  MOD_RES (16)..(16): Dpr
  c-term amidation

SEQ ID NO: 4428 - protein, 38 aa, Artificial Sequence; identical to SEQ ID NO: 4288
  Description of Artificial Sequence: Synthetic peptide
  MOD_RES (16)..(16): Dab
  c-term amidation

SEQ ID NO: 4429 - protein, 38 aa, Artificial Sequence; identical to SEQ ID NO: 4287
  Description of Artificial Sequence: Synthetic peptide
  c-term amidation

SEQ ID NO: 4430 - protein, 38 aa, Artificial Sequence; identical to SEQ ID NO: 4296
  Description of Artificial Sequence: Synthetic peptide
  MOD_RES (16)..(16): Orn
  c-term amidation

SEQ ID NO: 4431 - protein, 38 aa, Artificial Sequence; identical to SEQ ID NO: 4296
  Description of Artificial Sequence: Synthetic peptide
  MOD_RES (16)..(16): hLys
  c-term amidation

SEQ ID NO: 4432 - protein, 38 aa, Artificial Sequence; identical to SEQ ID NO: 4296
  Description of Artificial Sequence: Synthetic peptide
  MOD_RES (16)..(16): hArg
  c-term amidation

SEQ ID NO: 4433 - protein, 38 aa, Artificial Sequence; identical to SEQ ID NO: 4296
  Description of Artificial Sequence: Synthetic peptide
  MOD_RES (16)..(16): Cit
  c-term amidation

SEQ ID NO: 4434 - protein, 38 aa, Artificial Sequence; identical to SEQ ID NO: 4296
  Description of Artificial Sequence: Synthetic peptide
  MOD_RES (16)..(16): hCit
  c-term amidation

SEQ ID NO: 4435 - protein, 38 aa, Artificial Sequence; identical to SEQ ID NO: 4296
  Description of Artificial Sequence: Synthetic peptide
  MOD_RES (16)..(16): Dpr
  c-term amidation

SEQ ID NO: 4436 - protein, 38 aa, Artificial Sequence
  Description of Artificial Sequence: Synthetic peptide
  c-term amidation
GVIINVKCKISRQCLKPCKDAGMRFGKCMAGKCACGGG

SEQ ID NO: 4437 - protein, 38 aa, Artificial Sequence
  Description of Artificial Sequence: Synthetic peptide
  MOD_RES (16)..(16): Orn
  c-term amidation
GVIINVKCKISRQCLXPCKDAGMRFGKCMAGKCACFGG

SEQ ID NO: 4438 - protein, 38 aa, Artificial Sequence; identical to SEQ ID NO: 4303
  Description of Artificial Sequence: Synthetic peptide
  MOD_RES (16)..(16): Orn
  c-term amidation

SEQ ID NO: 4439 - protein, 38 aa, Artificial Sequence; identical to SEQ ID NO: 4303
  Description of Artificial Sequence: Synthetic peptide
  MOD_RES (16)..(16): hLys
  c-term amidation

SEQ ID NO: 4440 - protein, 38 aa, Artificial Sequence; identical to SEQ ID NO: 4303
  Description of Artificial Sequence: Synthetic peptide
  MOD_RES (16)..(16): hArg
  c-term amidation

SEQ ID NO: 4441 - protein, 38 aa, Artificial Sequence; identical to SEQ ID NO: 4303
  Description of Artificial Sequence: Synthetic peptide
  MOD_RES (16)..(16): Cit
  c-term amidation

SEQ ID NO: 4442 - protein, 38 aa, Artificial Sequence; identical to SEQ ID NO: 4303
  Description of Artificial Sequence: Synthetic peptide
  MOD_RES (16)..(16): hCit
  c-term amidation

SEQ ID NO: 4443 - protein, 38 aa, Artificial Sequence; identical to SEQ ID NO: 4303
  Description of Artificial Sequence: Synthetic peptide
  MOD_RES (16)..(16): Dpr
  c-term amidation

SEQ ID NO: 4444 - protein, 38 aa, Artificial Sequence; identical to SEQ ID NO: 4303
  Description of Artificial Sequence: Synthetic peptide
  MOD_RES (16)..(16): Dab
  c-term amidation

SEQ ID NO: 4445 - protein, 38 aa, Artificial Sequence; identical to SEQ ID NO: 4313
  Description of Artificial Sequence: Synthetic peptide
  MOD_RES (16)..(16): Orn
  c-term amidation

SEQ ID NO: 4446 - protein, 38 aa, Artificial Sequence; identical to SEQ ID NO: 4313
  Description of Artificial Sequence: Synthetic peptide
  MOD_RES (16)..(16): hLys
  c-term amidation

SEQ ID NO: 4447 - protein, 38 aa, Artificial Sequence; identical to SEQ ID NO: 4313
  Description of Artificial Sequence: Synthetic peptide
  MOD_RES (16)..(16): hArg
  c-term amidation

SEQ ID NO: 4448 - protein, 38 aa, Artificial Sequence; identical to SEQ ID NO: 4313
  Description of Artificial Sequence: Synthetic peptide
  MOD_RES (16)..(16): Cit
  c-term amidation

SEQ ID NO: 4449 - protein, 38 aa, Artificial Sequence; identical to SEQ ID NO: 4313
  Description of Artificial Sequence: Synthetic peptide
  MOD_RES (16)..(16): hCit
  c-term amidation

SEQ ID NO: 4450 - protein, 38 aa, Artificial Sequence; identical to SEQ ID NO: 4313
  Description of Artificial Sequence: Synthetic peptide
  MOD_RES (16)..(16): Dpr
  c-term amidation

SEQ ID NO: 4451 - protein, 38 aa, Artificial Sequence; identical to SEQ ID NO: 4313
  Description of Artificial Sequence: Synthetic peptide
  MOD_RES (16)..(16): Dab
  c-term amidation

SEQ ID NO: 4452 - protein, 38 aa, Artificial Sequence; identical to SEQ ID NO: 4319
  Description of Artificial Sequence: Synthetic peptide
  MOD_RES (16)..(16): Orn
  c-term amidation

SEQ ID NO: 4453 - protein, 38 aa, Artificial Sequence; identical to SEQ ID NO: 4319
  Description of Artificial Sequence: Synthetic peptide
  MOD_RES (16)..(16): hLys
  c-term amidation

SEQ ID NO: 4454 - protein, 38 aa, Artificial Sequence; identical to SEQ ID NO: 4319
  Description of Artificial Sequence: Synthetic peptide
  MOD_RES (16)..(16): hArg
  c-term amidation

SEQ ID NO: 4455 - protein, 38 aa, Artificial Sequence; identical to SEQ ID NO: 4319
  Description of Artificial Sequence: Synthetic peptide
  MOD_RES (16)..(16): Cit
  c-term amidation

SEQ ID NO: 4456 - protein, 38 aa, Artificial Sequence; identical to SEQ ID NO: 4319
  Description of Artificial Sequence: Synthetic peptide
  MOD_RES (16)..(16): hCit
  c-term amidation

SEQ ID NO: 4457 - protein, 38 aa, Artificial Sequence; identical to SEQ ID NO: 4319
  Description of Artificial Sequence: Synthetic peptide
  MOD_RES (16)..(16): Dpr
  c-term amidation

SEQ ID NO: 4458 - protein, 38 aa, Artificial Sequence; identical to SEQ ID NO: 4319
  Description of Artificial Sequence: Synthetic peptide
  MOD_RES (16)..(16): Dab
  c-term amidation

SEQ ID NO: 4459 - protein, 38 aa, Artificial Sequence; identical to SEQ ID NO: 4326
  Description of Artificial Sequence: Synthetic peptide
  MOD_RES (16)..(16): Orn
  c-term amidation

SEQ ID NO: 4460 - protein, 38 aa, Artificial Sequence; identical to SEQ ID NO: 4326
  Description of Artificial Sequence: Synthetic peptide
  MOD_RES (16)..(16): hLys
  c-term amidation

SEQ ID NO: 4461 - protein, 38 aa, Artificial Sequence; identical to SEQ ID NO: 4326
  Description of Artificial Sequence: Synthetic peptide
  MOD_RES (16)..(16): hArg
  c-term amidation

SEQ ID NO: 4462 - protein, 38 aa, Artificial Sequence; identical to SEQ ID NO: 4326
  Description of Artificial Sequence: Synthetic peptide
  MOD_RES (16)..(16): Cit
  c-term amidation

SEQ ID NO: 4463 - protein, 38 aa, Artificial Sequence; identical to SEQ ID NO: 4326
  Description of Artificial Sequence: Synthetic peptide
  MOD_RES (16)..(16): hCit
  c-term amidation

SEQ ID NO: 4464 - protein, 38 aa, Artificial Sequence; identical to SEQ ID NO: 4326
  Description of Artificial Sequence: Synthetic peptide
  MOD_RES (16)..(16): Dpr
  c-term amidation

SEQ ID NO: 4465 - protein, 38 aa, Artificial Sequence; identical to SEQ ID NO: 4326
  Description of Artificial Sequence: Synthetic peptide
  MOD_RES (16)..(16): Dab
  c-term amidation

SEQ ID NO: 4466 - protein, 35 aa, Artificial Sequence; identical to SEQ ID NO: 4333
  Description of Artificial Sequence: Synthetic peptide
  MOD_RES (16)..(16): Orn
  c-term amidation

SEQ ID NO: 4467 - protein, 35 aa, Artificial Sequence; identical to SEQ ID NO: 4333
  Description of Artificial Sequence: Synthetic peptide
  MOD_RES (16)..(16): hLys
  c-term amidation

SEQ ID NO: 4468 - protein, 35 aa, Artificial Sequence; identical to SEQ ID NO: 4333
  Description of Artificial Sequence: Synthetic peptide
  MOD_RES (16)..(16): hArg
  c-term amidation

SEQ ID NO: 4469 - protein, 35 aa, Artificial Sequence; identical to SEQ ID NO: 4333
  Description of Artificial Sequence: Synthetic peptide
  MOD_RES (16)..(16): Cit
  c-term amidation

SEQ ID NO: 4470 - protein, 35 aa, Artificial Sequence; identical to SEQ ID NO: 4333
  Description of Artificial Sequence: Synthetic peptide
  MOD_RES (16)..(16): hCit
  c-term amidation

SEQ ID NO: 4471 - protein, 35 aa, Artificial Sequence; identical to SEQ ID NO: 4333
  Description of Artificial Sequence: Synthetic peptide
  MOD_RES (16)..(16): Dpr
  c-term amidation

SEQ ID NO: 4472 - protein, 33 aa, Artificial Sequence
  Description of Artificial Sequence: Synthetic peptide
  MOD_RES (16)..(16): Orn
  c-term amidation
GVIINVKCKISRQCLXPCKEAGMRFGKCMAGKC

SEQ ID NO: 4473 - protein, 33 aa, Artificial Sequence; identical to SEQ ID NO: 4472
  Description of Artificial Sequence: Synthetic peptide
  MOD_RES (16)..(16): hLys
  c-term amidation

SEQ ID NO: 4474 - protein, 33 aa, Artificial Sequence; identical to SEQ ID NO: 4472
  Description of Artificial Sequence: Synthetic peptide
  MOD_RES (16)..(16): hArg
  c-term amidation

SEQ ID NO: 4475 - protein, 33 aa, Artificial Sequence; identical to SEQ ID NO: 4472
  Description of Artificial Sequence: Synthetic peptide
  MOD_RES (16)..(16): Cit
  c-term amidation

SEQ ID NO: 4476 - protein, 35 aa, Artificial Sequence; identical to SEQ ID NO: 4333
  Description of Artificial Sequence: Synthetic peptide
  MOD_RES (16)..(16): hCit
  c-term amidation

SEQ ID NO: 4477 - protein, 33 aa, Artificial Sequence; identical to SEQ ID NO: 4472
  Description of Artificial Sequence: Synthetic peptide
  MOD_RES (16)..(16): Dpr
  c-term amidation

SEQ ID NO: 4478 - protein, 33 aa, Artificial Sequence; identical to SEQ ID NO: 4472
  Description of Artificial Sequence: Synthetic peptide
  MOD_RES (16)..(16): Dab
  c-term amidation

SEQ ID NO: 4479 - protein, 38 aa, Artificial Sequence
  Description of Artificial Sequence: Synthetic peptide
  c-term amidation
GVIINVKCKISRQCLKPCKEAGMRFGKCMAGKCHCWGG

SEQ ID NO: 4480 - protein, 38 aa, Artificial Sequence; identical to SEQ ID NO: 4347
  Description of Artificial Sequence: Synthetic peptide
  MOD_RES (16)..(16): Orn
  c-term amidation

SEQ ID NO: 4481 - protein, 38 aa, Artificial Sequence; identical to SEQ ID NO: 4347
  Description of Artificial Sequence: Synthetic peptide
  MOD_RES (16)..(16): hLys
  c-term amidation

SEQ ID NO: 4482 - protein, 38 aa, Artificial Sequence; identical to SEQ ID NO: 4347
  Description of Artificial Sequence: Synthetic peptide
  MOD_RES (16)..(16): hArg
  c-term amidation

SEQ ID NO: 4483 - protein, 38 aa, Artificial Sequence; identical to SEQ ID NO: 4347
  Description of Artificial Sequence: Synthetic peptide
  MOD_RES (16)..(16): Cit
  c-term amidation

SEQ ID NO: 4484 - protein, 38 aa, Artificial Sequence; identical to SEQ ID NO: 4347
  Description of Artificial Sequence: Synthetic peptide
  MOD_RES (16)..(16): hCit
  c-term amidation

SEQ ID NO: 4485 - protein, 38 aa, Artificial Sequence; identical to SEQ ID NO: 4347
  Description of Artificial Sequence: Synthetic peptide
  MOD_RES (16)..(16): Dpr
  c-term amidation

SEQ ID NO: 4486 - protein, 38 aa, Artificial Sequence; identical to SEQ ID NO: 4347
  Description of Artificial Sequence: Synthetic peptide
  MOD_RES (16)..(16): Dab
  c-term amidation

SEQ ID NO: 4487 - protein, 38 aa, Artificial Sequence
  Description of Artificial Sequence: Synthetic peptide
  c-term amidation
GVIINVKCKISRQCLKPCKEAGMRFGKCMAGKCACYGG

SEQ ID NO: 4488 - protein, 38 aa, Artificial Sequence; identical to SEQ ID NO: 4357
  Description of Artificial Sequence: Synthetic peptide
  MOD_RES (16)..(16): Orn
  c-term amidation

SEQ ID NO: 4489 - protein, 38 aa, Artificial Sequence; identical to SEQ ID NO: 4357
  Description of Artificial Sequence: Synthetic peptide
  MOD_RES (16)..(16): hLys
  c-term amidation

SEQ ID NO: 4490 - protein, 38 aa, Artificial Sequence; identical to SEQ ID NO: 4357
  Description of Artificial Sequence: Synthetic peptide
  MOD_RES (16)..(16): hArg
  c-term amidation

SEQ ID NO: 4491 - protein, 38 aa, Artificial Sequence; identical to SEQ ID NO: 4357
  Description of Artificial Sequence: Synthetic peptide
  MOD_RES (16)..(16): Cit
  c-term amidation

SEQ ID NO: 4492 - protein, 38 aa, Artificial Sequence; identical to SEQ ID NO: 4347
  Description of Artificial Sequence: Synthetic peptide
  MOD_RES (16)..(16): hCit
  c-term amidation

SEQ ID NO: 4493 - protein, 38 aa, Artificial Sequence; identical to SEQ ID NO: 4357
  Description of Artificial Sequence: Synthetic peptide
  MOD_RES (16)..(16): Dpr
  c-term amidation

SEQ ID NO: 4494 - protein, 38 aa, Artificial Sequence; identical to SEQ ID NO: 4357
  Description of Artificial Sequence: Synthetic peptide
  MOD_RES (16)..(16): Dab
  c-term amidation

SEQ ID NO: 4495 - protein, 38 aa, Artificial Sequence; identical to SEQ ID NO: 4365
  Description of Artificial Sequence: Synthetic peptide
  MOD_RES (16)..(16): Orn
  c-term amidation

SEQ ID NO: 4496 - protein, 38 aa, Artificial Sequence; identical to SEQ ID NO: 4365
  Description of Artificial Sequence: Synthetic peptide
  MOD_RES (16)..(16): hLys
  c-term amidation

SEQ ID NO: 4497 - protein, 38 aa, Artificial Sequence; identical to SEQ ID NO: 4365
  Description of Artificial Sequence: Synthetic peptide
  MOD_RES (16)..(16): hArg
  c-term amidation

SEQ ID NO: 4498 - protein, 38 aa, Artificial Sequence; identical to SEQ ID NO: 4365
  Description of Artificial Sequence: Synthetic peptide
  MOD_RES (16)..(16): Cit
  c-term amidation

SEQ ID NO: 4499 - protein, 38 aa, Artificial Sequence; identical to SEQ ID NO: 4365
  Description of Artificial Sequence: Synthetic peptide
  MOD_RES (16)..(16): hCit
  c-term amidation

SEQ ID NO: 4500 - protein, 38 aa, Artificial Sequence; identical to SEQ ID NO: 4365
  Description of Artificial Sequence: Synthetic peptide
  MOD_RES (16)..(16): Dpr
  c-term amidation

SEQ ID NO: 4501 - protein, 38 aa, Artificial Sequence; identical to SEQ ID NO: 4371
  Description of Artificial Sequence: Synthetic peptide
  MOD_RES (16)..(16): Orn
  c-term amidation

SEQ ID NO: 4502 - protein, 38 aa, Artificial Sequence; identical to SEQ ID NO: 4371
  Description of Artificial Sequence: Synthetic peptide
  MOD_RES (16)..(16): hLys
  c-term amidation

SEQ ID NO: 4503 - protein, 38 aa, Artificial Sequence; identical to SEQ ID NO: 4371
  Description of Artificial Sequence: Synthetic peptide
  MOD_RES (16)..(16): hArg
  c-term amidation

SEQ ID NO: 4504 - protein, 38 aa, Artificial Sequence; identical to SEQ ID NO: 4371
  Description of Artificial Sequence: Synthetic peptide
  MOD_RES (16)..(16): Cit
  c-term amidation

SEQ ID NO: 4505 - protein, 37 aa, Artificial Sequence; identical to SEQ ID NO: 4375
  Description of Artificial Sequence: Synthetic peptide
  MOD_RES (16)..(16): hCit
  c-term amidation

SEQ ID NO: 4506 - protein, 38 aa, Artificial Sequence; identical to SEQ ID NO: 4371
  Description of Artificial Sequence: Synthetic peptide
  MOD_RES (16)..(16): Dpr
  c-term amidation

SEQ ID NO: 4507 - protein, 38 aa, Artificial Sequence; identical to SEQ ID NO: 4371
  Description of Artificial Sequence: Synthetic peptide
  MOD_RES (16)..(16): Dab
  c-term amidation

SEQ ID NO: 4508 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGKCMAGKCACYGG

SEQ ID NO: 4509 - protein, 38 aa, Artificial Sequence
  Description of Artificial Sequence: Synthetic peptide
  MOD_RES (20)..(20): Cpa
  c-term amidation
GVIINVKCKISRQCLKPCKXAGMRFGKCMAGKCACGGG

SEQ ID NO: 4510 - protein, 36 aa, Artificial Sequence
  Description of Artificial Sequence: Synthetic peptide
  MOD_RES (20)..(20): Cpa
  c-term amidation
GVIINVKCKISRQCLKPCKXAGMRFGKCMAGKCACY

SEQ ID NO: 4511 - protein, 38 aa, Artificial Sequence; identical to SEQ ID NO: 4287
  Description of Artificial Sequence: Synthetic peptide
  c-term amidation

SEQ ID NO: 4512 - protein, 38 aa, Artificial Sequence; identical to SEQ ID NO: 4508
  Description of Artificial Sequence: Synthetic peptide
  MOD_RES (20)..(20): Aad
  c-term amidation

SEQ ID NO: 4513 - protein, 38 aa, Artificial Sequence
  Description of Artificial Sequence: Synthetic peptide
  MOD_RES (20)..(20): Aad
  c-term amidation
GVIINVKCKISRQCLKPCKXAGMRFGKCMAGKCHCYGG

SEQ ID NO: 4514 - protein, 38 aa, Artificial Sequence; identical to SEQ ID NO: 4508
  Description of Artificial Sequence: Synthetic peptide
  MOD_RES (20)..(20): Aad

SEQ ID NO: 4515 - protein, 38 aa, Artificial Sequence
  Description of Artificial Sequence: Synthetic peptide
  c-term amidation
GVIINVKCKISRQCLHPCKDAGMRFGKCMAGKCACYGG

SEQ ID NO: 4516 - protein, 38 aa, Artificial Sequence; identical to SEQ ID NO: 4515
  Description of Artificial Sequence: Synthetic peptide

SEQ ID NO: 4517 - protein, 36 aa, Artificial Sequence
  Description of Artificial Sequence: Synthetic peptide
  c-term amidation
GVIINVKCKISRQCLHPCKDAGMRFGKCMAGKCACY

SEQ ID NO: 4518 - protein, 38 aa, Artificial Sequence
  Description of Artificial Sequence: Synthetic peptide
  c-term amidation
GVIINVKCKISRQCLHPCKDAGMRFGKCMAGKCHCYGG

SEQ ID NO: 4519 - protein, 38 aa, Artificial Sequence; identical to SEQ ID NO: 4518
  Description of Artificial Sequence: Synthetic peptide

SEQ ID NO: 4520 - protein, 38 aa, Artificial Sequence
  Description of Artificial Sequence: Synthetic peptide
GVIINVKCKISRQCLHPCKDAGMRFGKCMAGKCHCYPK

SEQ ID NO: 4521 - protein, 35 aa, Artificial Sequence
  Description of Artificial Sequence: Synthetic peptide
GVIINVKCKISRQCLHPCKDAGMRFGKCMAGKCAC

SEQ ID NO: 4522 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGKCMAGKCACXGG

SEQ ID NO: 4523 - protein, 38 aa, Artificial Sequence
  Description of Artificial Sequence: Synthetic peptide
  MOD_RES (36)..(36): 1Nal
  c-term amidation
GVIINVKCKISRQCLKPCKDAGMRFGKCMAGKCACXPK

SEQ ID NO: 4524 - protein, 38 aa, Artificial Sequence; identical to SEQ ID NO: 4522
  Description of Artificial Sequence: Synthetic peptide
  MOD_RES (36)..(36): 2Nal
  c-term amidation

SEQ ID NO: 4525 - protein, 38 aa, Artificial Sequence; identical to SEQ ID NO: 4522
  Description of Artificial Sequence: Synthetic peptide
  MOD_RES (36)..(36): Cha
  c-term amidation

SEQ ID NO: 4526 - protein, 38 aa, Artificial Sequence; identical to SEQ ID NO: 4522
  Description of Artificial Sequence: Synthetic peptide
  MOD_RES (36)..(36): MePhe
  c-term amidation

SEQ ID NO: 4527 - protein, 38 aa, Artificial Sequence; identical to SEQ ID NO: 4522
  Description of Artificial Sequence: Synthetic peptide
  MOD_RES (36)..(36): BiPhA
  c-term amidation

SEQ ID NO: 4528 - protein, 38 aa, Artificial Sequence
  Description of Artificial Sequence: Synthetic peptide
  MOD_RES (34)..(34): Aib
  c-term amidation
GVIINVKCKISRQCLKPCKDAGMRFGKCMAGKCXCYGG

SEQ ID NO: 4529 - protein, 38 aa, Artificial Sequence; identical to SEQ ID NO: 4528
  Description of Artificial Sequence: Synthetic peptide
  MOD_RES (34)..(34): Abu
  c-term amidation

SEQ ID NO: 4530 - protein, 36 aa, Artificial Sequence
  Description of Artificial Sequence: Synthetic peptide
  MOD_RES (36)..(36): 1Nal
GVIINVKCKISRQCLKPCKDAGMRFGKCMAGKCACX

SEQ ID NO: 4531 - protein, 38 aa, Artificial Sequence
  Description of Artificial Sequence: Synthetic peptide
  MOD_RES (36)..(36): 1Nal
  c-term amidation
GVIINVKCKISRQCLHPCKDAGMRFGKCMAGKCACXGG

SEQ ID NO: 4532 - protein, 36 aa, Artificial Sequence; identical to SEQ ID NO: 4530
  Description of Artificial Sequence: Synthetic peptide
  MOD_RES (36)..(36): 4Bip
  c-term amidation

SEQ ID NO: 4533 - protein, 38 aa, Artificial Sequence; identical to SEQ ID NO: 4531
  Description of Artificial Sequence: Synthetic peptide
  MOD_RES (36)..(36): 4Bip
  c-term amidation

SEQ ID NO: 4534 - protein, 38 aa, Artificial Sequence
  Description of Artificial Sequence: Synthetic peptide
GVIINVKCKISRQCLKPCKDAGMRFGKCMAGKCHCGGG

SEQ ID NO: 4535 - protein, 38 aa, Artificial Sequence
  Description of Artificial Sequence: Synthetic peptide
GVIINVKCKIAAQCLEPCKKAGMRFGACAAGKCHCTPK

SEQ ID NO: 4536 - protein, 38 aa, Artificial Sequence
  Description of Artificial Sequence: Synthetic peptide
GVIINVSCKIAAQCLEPCKKAGMRFGACAAGKCHCTPK

SEQ ID NO: 4537 - protein, 38 aa, Artificial Sequence
  Description of Artificial Sequence: Synthetic peptide
GVIINVKCKIAAQCLKPCKKAGMRFGACAAGKCHCTPK

SEQ ID NO: 4538 - protein, 38 aa, Artificial Sequence
  Description of Artificial Sequence: Synthetic peptide
GVIINVKCKIAAQCLEPCKDAGMRFGACAAGKCHCTPK

SEQ ID NO: 4539 - protein, 38 aa, Artificial Sequence
  Description of Artificial Sequence: Synthetic peptide
GVIINVKCKIAAQCLKPCKDAGMRFGACAAGKCHCTPK

SEQ ID NO: 4540 - protein, 38 aa, Artificial Sequence
  Description of Artificial Sequence: Synthetic peptide
GVIINVSCKIAAQCLKPCKDAGMRFGACAAGKCHCTPK

SEQ ID NO: 4541 - protein, 38 aa, Artificial Sequence
  Description of Artificial Sequence: Synthetic peptide
GVIINVKCKISPQCLKPCKDAGMRFGACAAGKCHCTPK

SEQ ID NO: 4542 - protein, 38 aa, Artificial Sequence
  Description of Artificial Sequence: Synthetic peptide
GVIINVKCKIAAQCLKPCKDAGMRFGACAAGKCHCYPK

SEQ ID NO: 4543 - protein, 38 aa, Artificial Sequence; identical to SEQ ID NO: 4541
  Description of Artificial Sequence: Synthetic peptide
  n-term acetylation

SEQ ID NO: 4544 - protein, 38 aa, Artificial Sequence; identical to SEQ ID NO: 4541
  Description of Artificial Sequence: Synthetic peptide
  c-term amidation

SEQ ID NO: 4545 - protein, 38 aa, Artificial Sequence; identical to SEQ ID NO: 4541
  Description of Artificial Sequence: Synthetic peptide
  n-term acetylation
  c-term amidation

SEQ ID NO: 4546 - protein, 38 aa, Artificial Sequence; identical to SEQ ID NO: 4542
  Description of Artificial Sequence: Synthetic peptide
  c-term amidation

SEQ ID NO: 4547 - protein, 38 aa, Artificial Sequence; identical to SEQ ID NO: 4542
  Description of Artificial Sequence: Synthetic peptide
  n-term acetylation

SEQ ID NO: 4548 - protein, 38 aa, Artificial Sequence; identical to SEQ ID NO: 4542
  Description of Artificial Sequence: Synthetic peptide
  n-term acetylation
  c-term amidation

SEQ ID NO: 4549 - protein, 38 aa, Artificial Sequence; identical to SEQ ID NO: 4537
  Description of Artificial Sequence: Synthetic peptide
  c-term amidation

SEQ ID NO: 4550 - protein, 38 aa, Artificial Sequence; identical to SEQ ID NO: 4537
  Description of Artificial Sequence: Synthetic peptide
  n-term acetylation

SEQ ID NO: 4551 - protein, 38 aa, Artificial Sequence; identical to SEQ ID NO: 4537
  Description of Artificial Sequence: Synthetic peptide
  n-term acetylation
  c-term amidation

SEQ ID NO: 4552 - protein, 38 aa, Artificial Sequence; identical to SEQ ID NO: 4538
  Description of Artificial Sequence: Synthetic peptide
  n-term acetylation

SEQ ID NO: 4553 - protein, 38 aa, Artificial Sequence; identical to SEQ ID NO: 4538
  Description of Artificial Sequence: Synthetic peptide
  c-term amidation

SEQ ID NO: 4554 - protein, 38 aa, Artificial Sequence; identical to SEQ ID NO: 4538
  Description of Artificial Sequence: Synthetic peptide
  n-term acetylation
  c-term amidation

SEQ ID NO: 4555 - protein, 38 aa, Artificial Sequence; identical to SEQ ID NO: 4535
  Description of Artificial Sequence: Synthetic peptide
  c-term amidation

SEQ ID NO: 4556 - protein, 38 aa, Artificial Sequence; identical to SEQ ID NO: 4535
  Description of Artificial Sequence: Synthetic peptide
  n-term acetylation

SEQ ID NO: 4557 - protein, 38 aa, Artificial Sequence; identical to SEQ ID NO: 4535
  Description of Artificial Sequence: Synthetic peptide
  n-term acetylation
  c-term amidation

SEQ ID NO: 4558 - protein, 38 aa, Artificial Sequence; identical to SEQ ID NO: 4539
  Description of Artificial Sequence: Synthetic peptide
  c-term amidation

SEQ ID NO: 4559 - protein, 38 aa, Artificial Sequence; identical to SEQ ID NO: 4539
  Description of Artificial Sequence: Synthetic peptide
  n-term acetylation

SEQ ID NO: 4560 - protein, 38 aa, Artificial Sequence; identical to SEQ ID NO: 4539
  Description of Artificial Sequence: Synthetic peptide
  n-term acetylation
  c-term amidation

SEQ ID NO: 4561 - protein, 37 aa, Artificial Sequence
  Description of Artificial Sequence: Synthetic peptide
VIINVKCKIAAQCLEPCKKAGMRFGACAAGKCHCTPK

SEQ ID NO: 4562 - protein, 37 aa, Artificial Sequence; identical to SEQ ID NO: 4561
  Description of Artificial Sequence: Synthetic peptide
  n-term acetylation

SEQ ID NO: 4563 - protein, 37 aa, Artificial Sequence; identical to SEQ ID NO: 4561
  Description of Artificial Sequence: Synthetic peptide
  c-term amidation

SEQ ID NO: 4564 - protein, 37 aa, Artificial Sequence; identical to SEQ ID NO: 4561
  Description of Artificial Sequence: Synthetic peptide
  n-term acetylation
  c-term amidation

SEQ ID NO: 4565 - protein, 38 aa, Artificial Sequence
  Description of Artificial Sequence: Synthetic peptide
GVIINVKCKIAAQCLEPCKKAGMRFGACAAGKCACTPK

SEQ ID NO: 4566 - protein, 38 aa, Artificial Sequence; identical to SEQ ID NO: 4565
  Description of Artificial Sequence: Synthetic peptide
  n-term acetylation

SEQ ID NO: 4567 - protein, 38 aa, Artificial Sequence; identical to SEQ ID NO: 4565
  Description of Artificial Sequence: Synthetic peptide
  c-term amidation

SEQ ID NO: 4568 - protein, 38 aa, Artificial Sequence; identical to SEQ ID NO: 4565
  Description of Artificial Sequence: Synthetic peptide
  n-term acetylation
  c-term amidation

SEQ ID NO: 4569 - protein, 37 aa, Artificial Sequence
  Description of Artificial Sequence: Synthetic peptide
VIINVKCKIAAQCLKPCKDAGMRFGACAAGKCHCTPK

SEQ ID NO: 4570 - protein, 37 aa, Artificial Sequence; identical to SEQ ID NO: 4569
  Description of Artificial Sequence: Synthetic peptide
  n-term acetylation

SEQ ID NO: 4571 - protein, 37 aa, Artificial Sequence; identical to SEQ ID NO: 4569
  Description of Artificial Sequence: Synthetic peptide
  c-term amidation

SEQ ID NO: 4572 - protein, 37 aa, Artificial Sequence; identical to SEQ ID NO: 4569
  Description of Artificial Sequence: Synthetic peptide
  n-term acetylation
  c-term amidation

SEQ ID NO: 4573 - protein, 34 aa, Artificial Sequence
  Description of Artificial Sequence: Synthetic peptide
NVKCKIAAQCLKPCKDAGMRFGACAAGKCHCTPK

SEQ ID NO: 4574 - protein, 34 aa, Artificial Sequence; identical to SEQ ID NO: 4573
  Description of Artificial Sequence: Synthetic peptide
  n-term acetylation

SEQ ID NO: 4575 - protein, 34 aa, Artificial Sequence; identical to SEQ ID NO: 4573
  Description of Artificial Sequence: Synthetic peptide
  c-term amidation

SEQ ID NO: 4576 - protein, 34 aa, Artificial Sequence; identical to SEQ ID NO: 4573
  Description of Artificial Sequence: Synthetic peptide
  n-term acetylation
  c-term amidation

SEQ ID NO: 4577 - protein, 32 aa, Artificial Sequence
  Description of Artificial Sequence: Synthetic peptide
KCKIAAQCLKPCKDAGMRFGACAAGKCHCTPK

SEQ ID NO: 4578 - protein, 32 aa, Artificial Sequence; identical to SEQ ID NO: 4577
  Description of Artificial Sequence: Synthetic peptide
  n-term acetylation

SEQ ID NO: 4579 - protein, 32 aa, Artificial Sequence; identical to SEQ ID NO: 4577
  Description of Artificial Sequence: Synthetic peptide
  c-term amidation

SEQ ID NO: 4580 - protein, 32 aa, Artificial Sequence; identical to SEQ ID NO: 4577
  Description of Artificial Sequence: Synthetic peptide
  n-term acetylation
  c-term amidation

SEQ ID NO: 4581 - protein, 31 aa, Artificial Sequence
  Description of Artificial Sequence: Synthetic peptide
CKIAAQCLKPCKDAGMRFGACAAGKCHCTPK

SEQ ID NO: 4582 - protein, 31 aa, Artificial Sequence; identical to SEQ ID NO: 4581
  Description of Artificial Sequence: Synthetic peptide
  n-term acetylation

SEQ ID NO: 4583 - protein, 31 aa, Artificial Sequence; identical to SEQ ID NO: 4581
  Description of Artificial Sequence: Synthetic peptide
  c-term amidation

SEQ ID NO: 4584 - protein, 31 aa, Artificial Sequence; identical to SEQ ID NO: 4581
  Description of Artificial Sequence: Synthetic peptide
  n-term acetylation
  c-term amidation

SEQ ID NO: 4585 - protein, 38 aa, Artificial Sequence
  Description of Artificial Sequence: Synthetic peptide
GVIINVKCKIAAQCLKPCKDAGMRNGACAAGKCHCTPK

SEQ ID NO: 4586 - protein, 38 aa, Artificial Sequence; identical to SEQ ID NO: 4585
  Description of Artificial Sequence: Synthetic peptide
  c-term amidation

SEQ ID NO: 4587 - protein, 38 aa, Artificial Sequence; identical to SEQ ID NO: 4585
  Description of Artificial Sequence: Synthetic peptide
  n-term acetylation

SEQ ID NO: 4588 - protein, 38 aa, Artificial Sequence; identical to SEQ ID NO: 4585
  Description of Artificial Sequence: Synthetic peptide
  n-term acetylation
  c-term amidation

SEQ ID NO: 4589 - protein, 38 aa, Artificial Sequence
  Description of Artificial Sequence: Synthetic peptide
GVIINVKCKIAAQCLKPCKDAGMRFGKCMNRKCHCTPK

SEQ ID NO: 4590 - protein, 38 aa, Artificial Sequence; identical to SEQ ID NO: 4589
  Description of Artificial Sequence: Synthetic peptide
  c-term amidation

SEQ ID NO: 4591 - protein, 38 aa, Artificial Sequence; identical to SEQ ID NO: 4589
  Description of Artificial Sequence: Synthetic peptide
  n-term acetylation

SEQ ID NO: 4592 - protein, 38 aa, Artificial Sequence; identical to SEQ ID NO: 4589
  Description of Artificial Sequence: Synthetic peptide
  n-term acetylation
  c-term amidation

SEQ ID NO: 4593 - protein, 38 aa, Artificial Sequence
  Description of Artificial Sequence: Synthetic peptide
GVIINVKCKISKQCLKPCRDAGMRFGACAAGKCHCTPK

SEQ ID NO: 4594 - protein, 38 aa, Artificial Sequence; identical to SEQ ID NO: 4593
  Description of Artificial Sequence: Synthetic peptide
  n-term acetylation

SEQ ID NO: 4595 - protein, 38 aa, Artificial Sequence; identical to SEQ ID NO: 4593
  Description of Artificial Sequence: Synthetic peptide
  c-term amidation

SEQ ID NO: 4596 - protein, 38 aa, Artificial Sequence; identical to SEQ ID NO: 4593
  Description of Artificial Sequence: Synthetic peptide
  n-term acetylation
  c-term amidation

SEQ ID NO: 4597 - protein, 37 aa, Artificial Sequence
  Description of Artificial Sequence: Synthetic peptide
TIINVKCKIAAQCLKPCKDAGMRFGACAAGKCHCTPK

SEQ ID NO: 4598 - protein, 37 aa, Artificial Sequence; identical to SEQ ID NO: 4597
  Description of Artificial Sequence: Synthetic peptide
  n-term acetylation

SEQ ID NO: 4599 - protein, 37 aa, Artificial Sequence; identical to SEQ ID NO: 4597
  Description of Artificial Sequence: Synthetic peptide
  c-term amidation

SEQ ID NO: 4600 - protein, 37 aa, Artificial Sequence; identical to SEQ ID NO: 4597
  Description of Artificial Sequence: Synthetic peptide
  n-term acetylation
  c-term amidation

SEQ ID NO: 4601 - protein, 38 aa, Artificial Sequence
  Description of Artificial Sequence: Synthetic peptide
GVKINVKCKIAAQCLEPCKKAGMRFGACAAGKCHCTPK

SEQ ID NO: 4602 - protein, 38 aa, Artificial Sequence; identical to SEQ ID NO: 4601
  Description of Artificial Sequence: Synthetic peptide
  n-term acetylation

SEQ ID NO: 4603 - protein, 38 aa, Artificial Sequence; identical to SEQ ID NO: 4601
  Description of Artificial Sequence: Synthetic peptide
  c-term amidation

SEQ ID NO: 4604 - protein, 38 aa, Artificial Sequence; identical to SEQ ID NO: 4601
  Description of Artificial Sequence: Synthetic peptide
  n-term acetylation
  c-term amidation

SEQ ID NO: 4605 - protein, 38 aa, Artificial Sequence
  Description of Artificial Sequence: Synthetic peptide
GVKINVKCKIAAQCLEPCKKAGMRFGACAAGKCACTPK

SEQ ID NO: 4606 - protein, 38 aa, Artificial Sequence
  Description of Artificial Sequence: Synthetic peptide
GVKINVKCKIAAQCLKPCKDAGMRFGACAAGKCHCTPK

SEQ ID NO: 4607 - protein, 38 aa, Artificial Sequence
  Description of Artificial Sequence: Synthetic peptide
GVKINVKCKIAAQCLKPCKDAGMRFGACAAGKCACTPK

SEQ ID NO: 4608 - protein, 38 aa, Artificial Sequence; identical to SEQ ID NO: 4605
  Description of Artificial Sequence: Synthetic peptide
  n-term acetylation

SEQ ID NO: 4609 - protein, 38 aa, Artificial Sequence; identical to SEQ ID NO: 4605
  Description of Artificial Sequence: Synthetic peptide
  c-term amidation

SEQ ID NO: 4610 - protein, 38 aa, Artificial Sequence; identical to SEQ ID NO: 4605
  Description of Artificial Sequence: Synthetic peptide
  n-term acetylation
  c-term amidation

SEQ ID NO: 4611 - protein, 38 aa, Artificial Sequence; identical to SEQ ID NO: 4607
  Description of Artificial Sequence: Synthetic peptide
  n-term acetylation

SEQ ID NO: 4612 - protein, 38 aa, Artificial Sequence; identical to SEQ ID NO: 4607
  Description of Artificial Sequence: Synthetic peptide
  c-term amidation

SEQ ID NO: 4613 - protein, 38 aa, Artificial Sequence; identical to SEQ ID NO: 4607
  Description of Artificial Sequence: Synthetic peptide
  n-term acetylation
  c-term amidation

SEQ ID NO: 4614 - protein, 38 aa, Artificial Sequence; identical to SEQ ID NO: 4606
  Description of Artificial Sequence: Synthetic peptide
  n-term acetylation

SEQ ID NO: 4615 - protein, 38 aa, Artificial Sequence; identical to SEQ ID NO: 4606
  Description of Artificial Sequence: Synthetic peptide
  c-term amidation

SEQ ID NO: 4616 - protein, 38 aa, Artificial Sequence; identical to SEQ ID NO: 4606
  Description of Artificial Sequence: Synthetic peptide
  n-term acetylation
  c-term amidation

SEQ ID NO: 4617 - protein, 36 aa, Artificial Sequence
  Description of Artificial Sequence: Synthetic peptide
GVIINVKCKIAAQCLKPCKDAGMRFGACAAGKCHCT

SEQ ID NO: 4618 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCHCTPK

SEQ ID NO: 4619 - protein, 38 aa, Artificial Sequence; identical to SEQ ID NO: 4618
  Description of Artificial Sequence: Synthetic peptide
  MOD_RES (16)..(16): hLys

SEQ ID NO: 4620 - protein, 38 aa, Artificial Sequence; identical to SEQ ID NO: 4618
  Description of Artificial Sequence: Synthetic peptide
  MOD_RES (16)..(16): hArg

SEQ ID NO: 4621 - protein, 38 aa, Artificial Sequence; identical to SEQ ID NO: 4618
  Description of Artificial Sequence: Synthetic peptide
  MOD_RES (16)..(16): Cit

SEQ ID NO: 4622 - protein, 38 aa, Artificial Sequence; identical to SEQ ID NO: 4618
  Description of Artificial Sequence: Synthetic peptide
  MOD_RES (16)..(16): hCit

SEQ ID NO: 4623 - protein, 38 aa, Artificial Sequence; identical to SEQ ID NO: 4618
  Description of Artificial Sequence: Synthetic peptide
  MOD_RES (16)..(16): Dpr

SEQ ID NO: 4624 - protein, 38 aa, Artificial Sequence; identical to SEQ ID NO: 4618
  Description of Artificial Sequence: Synthetic peptide
  MOD_RES (16)..(16): Dab

SEQ ID NO: 4625 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCHCYPK

SEQ ID NO: 4626 - protein, 38 aa, Artificial Sequence; identical to SEQ ID NO: 4625
  Description of Artificial Sequence: Synthetic peptide
  MOD_RES (16)..(16): hLys

SEQ ID NO: 4627 - protein, 38 aa, Artificial Sequence; identical to SEQ ID NO: 4625
  Description of Artificial Sequence: Synthetic peptide
  MOD_RES (16)..(16): hArg

SEQ ID NO: 4628 - protein, 38 aa, Artificial Sequence; identical to SEQ ID NO: 4625
  Description of Artificial Sequence: Synthetic peptide
  MOD_RES (16)..(16): Cit

SEQ ID NO: 4629 - protein, 38 aa, Artificial Sequence; identical to SEQ ID NO: 4625
  Description of Artificial Sequence: Synthetic peptide
  MOD_RES (16)..(16): hCit

SEQ ID NO: 4630 - protein, 38 aa, Artificial Sequence; identical to SEQ ID NO: 4625
  Description of Artificial Sequence: Synthetic peptide
  MOD_RES (16)..(16): Dpr

SEQ ID NO: 4631 - protein, 38 aa, Artificial Sequence; identical to SEQ ID NO: 4625
  Description of Artificial Sequence: Synthetic peptide
  MOD_RES (16)..(16): Dab

SEQ ID NO: 4632 - protein, 38 aa, Artificial Sequence
  Description of Artificial Sequence: Synthetic peptide
GVIINVKCKIAAQCLKPCKDAGMRFGACAAGKCACYPK

SEQ ID NO: 4633 - protein, 38 aa, Artificial Sequence
  Description of Artificial Sequence: Synthetic peptide
GVIINVKCKIAAQCLKPCKDAGMRFGACAAGKCGCYPK

SEQ ID NO: 4634 - protein, 38 aa, Artificial Sequence
  Description of Artificial Sequence: Synthetic peptide
GVIINVKCKIAAQCLKPCKDAGMRFGACAAGKCACFPK

SEQ ID NO: 4635 - protein, 38 aa, Artificial Sequence
  Description of Artificial Sequence: Synthetic peptide
GVIINVKCKIAAQCLKPCKDAGMRFGACAAGKCACWPK

SEQ ID NO: 4636 - protein, 38 aa, Artificial Sequence
  Description of Artificial Sequence: Synthetic peptide
GVIINVKCKIAAQCLKPCKEAGMRFGACAAGKCACYPK

SEQ ID NO: 4637 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCACTPK

SEQ ID NO: 4638 - protein, 38 aa, Artificial Sequence; identical to SEQ ID NO: 4637
  Description of Artificial Sequence: Synthetic peptide
  MOD_RES (16)..(16): hLys

SEQ ID NO: 4639 - protein, 38 aa, Artificial Sequence; identical to SEQ ID NO: 4637
  Description of Artificial Sequence: Synthetic peptide
  MOD_RES (16)..(16): hArg

SEQ ID NO: 4640 - protein, 38 aa, Artificial Sequence; identical to SEQ ID NO: 4637
  Description of Artificial Sequence: Synthetic peptide
  MOD_RES (16)..(16): Cit

SEQ ID NO: 4641 - protein, 38 aa, Artificial Sequence; identical to SEQ ID NO: 4618
  Description of Artificial Sequence: Synthetic peptide
  MOD_RES (16)..(16): hCit

SEQ ID NO: 4642 - protein, 38 aa, Artificial Sequence; identical to SEQ ID NO: 4637
  Description of Artificial Sequence: Synthetic peptide
  MOD_RES (16)..(16): Dpr

SEQ ID NO: 4643 - protein, 38 aa, Artificial Sequence; identical to SEQ ID NO: 4637
  Description of Artificial Sequence: Synthetic peptide
  MOD_RES (16)..(16): Dab

SEQ ID NO: 4644 - protein, 35 aa, Artificial Sequence
  Description of Artificial Sequence: Synthetic peptide
  MOD_RES (16)..(16): Orn
GVIINVKCKIAAQCLXPCKDAGMRFGACAAGKCHC

SEQ ID NO: 4645 - protein, 35 aa, Artificial Sequence; identical to SEQ ID NO: 4644
  Description of Artificial Sequence: Synthetic peptide
  MOD_RES (16)..(16): hLys

SEQ ID NO: 4646 - protein, 35 aa, Artificial Sequence; identical to SEQ ID NO: 4644
  Description of Artificial Sequence: Synthetic peptide
  MOD_RES (16)..(16): hArg

SEQ ID NO: 4647 - protein, 35 aa, Artificial Sequence; identical to SEQ ID NO: 4644
  Description of Artificial Sequence: Synthetic peptide
  MOD_RES (16)..(16): Cit

SEQ ID NO: 4648 - protein, 35 aa, Artificial Sequence; identical to SEQ ID NO: 4644
  Description of Artificial Sequence: Synthetic peptide
  MOD_RES (16)..(16): hCit

SEQ ID NO: 4649 - protein, 35 aa, Artificial Sequence; identical to SEQ ID NO: 4644
  Description of Artificial Sequence: Synthetic peptide
  MOD_RES (16)..(16): Dpr

SEQ ID NO: 4650 - protein, 35 aa, Artificial Sequence; identical to SEQ ID NO: 4644
  Description of Artificial Sequence: Synthetic peptide
  MOD_RES (16)..(16): Dab

SEQ ID NO: 4651 - protein, 35 aa, Artificial Sequence
  Description of Artificial Sequence: Synthetic peptide
  MOD_RES (16)..(16): Orn
GVIINVKCKIAAQCLXPCKDAGMRFGACAAGKCAC

SEQ ID NO: 4652 - protein, 35 aa, Artificial Sequence; identical to SEQ ID NO: 4651
  Description of Artificial Sequence: Synthetic peptide
  MOD_RES (16)..(16): hLys

SEQ ID NO: 4653 - protein, 35 aa, Artificial Sequence; identical to SEQ ID NO: 4651
  Description of Artificial Sequence: Synthetic peptide
  MOD_RES (16)..(16): hArg

SEQ ID NO: 4654 - protein, 35 aa, Artificial Sequence; identical to SEQ ID NO: 4651
  Description of Artificial Sequence: Synthetic peptide
  MOD_RES (16)..(16): Cit

SEQ ID NO: 4655 - protein, 35 aa, Artificial Sequence; identical to SEQ ID NO: 4644
  Description of Artificial Sequence: Synthetic peptide
  MOD_RES (16)..(16): hCit

SEQ ID NO: 4656 - protein, 35 aa, Artificial Sequence; identical to SEQ ID NO: 4651
  Description of Artificial Sequence: Synthetic peptide
  MOD_RES (16)..(16): Dpr

SEQ ID NO: 4657 - protein, 35 aa, Artificial Sequence; identical to SEQ ID NO: 4651
  Description of Artificial Sequence: Synthetic peptide
  MOD_RES (16)..(16): Dab

SEQ ID NO: 4658 - protein, 38 aa, Artificial Sequence
  Description of Artificial Sequence: Synthetic peptide
GVIINVKCKIAAQCLKPCKDAGMRFGACAAGKCGCYGG

SEQ ID NO: 4659 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCHCYGG

SEQ ID NO: 4660 - protein, 38 aa, Artificial Sequence; identical to SEQ ID NO: 4659
  Description of Artificial Sequence: Synthetic peptide
  MOD_RES (16)..(16): hLys

SEQ ID NO: 4661 - protein, 38 aa, Artificial Sequence; identical to SEQ ID NO: 4659
  Description of Artificial Sequence: Synthetic peptide
  MOD_RES (16)..(16): hArg

SEQ ID NO: 4662 - protein, 38 aa, Artificial Sequence; identical to SEQ ID NO: 4659
  Description of Artificial Sequence: Synthetic peptide
  MOD_RES (16)..(16): Cit

SEQ ID NO: 4663 - protein, 38 aa, Artificial Sequence; identical to SEQ ID NO: 4659
  Description of Artificial Sequence: Synthetic peptide
  MOD_RES (16)..(16): hCit

SEQ ID NO: 4664 - protein, 38 aa, Artificial Sequence; identical to SEQ ID NO: 4659
  Description of Artificial Sequence: Synthetic peptide
  MOD_RES (16)..(16): Dpr

SEQ ID NO: 4665 - protein, 38 aa, Artificial Sequence
  Description of Artificial Sequence: Synthetic peptide
GVIINVKCKIAAQCLKPCKDAGMRFGACAAGKCACYGG

SEQ ID NO: 4666 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCACYGG

SEQ ID NO: 4667 - protein, 38 aa, Artificial Sequence; identical to SEQ ID NO: 4666
  Description of Artificial Sequence: Synthetic peptide
  MOD_RES (16)..(16): hLys

SEQ ID NO: 4668 - protein, 38 aa, Artificial Sequence; identical to SEQ ID NO: 4666
  Description of Artificial Sequence: Synthetic peptide
  MOD_RES (16)..(16): hArg

SEQ ID NO: 4669 - protein, 38 aa, Artificial Sequence; identical to SEQ ID NO: 4666
  Description of Artificial Sequence: Synthetic peptide
  MOD_RES (16)..(16): Cit

SEQ ID NO: 4670 - protein, 38 aa, Artificial Sequence; identical to SEQ ID NO: 4659
  Description of Artificial Sequence: Synthetic peptide
  MOD_RES (16)..(16): hCit

SEQ ID NO: 4671 - protein, 38 aa, Artificial Sequence; identical to SEQ ID NO: 4666
  Description of Artificial Sequence: Synthetic peptide
  MOD_RES (16)..(16): Dpr

SEQ ID NO: 4672 - protein, 38 aa, Artificial Sequence; identical to SEQ ID NO: 4666
  Description of Artificial Sequence: Synthetic peptide
  MOD_RES (16)..(16): Dab

SEQ ID NO: 4673 - protein, 37 aa, Artificial Sequence
  Description of Artificial Sequence: Synthetic peptide
GVIINVKCKIAAQCLKPCKDAGMRFGACAAGKCACYG

SEQ ID NO: 4674 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCHCGGG

SEQ ID NO: 4675 - protein, 38 aa, Artificial Sequence; identical to SEQ ID NO: 4674
  Description of Artificial Sequence: Synthetic peptide
  MOD_RES (16)..(16): hLys

SEQ ID NO: 4676 - protein, 38 aa, Artificial Sequence; identical to SEQ ID NO: 4674
  Description of Artificial Sequence: Synthetic peptide
  MOD_RES (16)..(16): hArg

SEQ ID NO: 4677 - protein, 38 aa, Artificial Sequence; identical to SEQ ID NO: 4674
  Description of Artificial Sequence: Synthetic peptide
  MOD_RES (16)..(16): Cit

SEQ ID NO: 4678 - protein, 38 aa, Artificial Sequence; identical to SEQ ID NO: 4674
  Description of Artificial Sequence: Synthetic peptide
  MOD_RES (16)..(16): hCit

SEQ ID NO: 4679 - protein, 38 aa, Artificial Sequence; identical to SEQ ID NO: 4674
  Description of Artificial Sequence: Synthetic peptide
  MOD_RES (16)..(16): Dpr

SEQ ID NO: 4680 - protein, 38 aa, Artificial Sequence
  Description of Artificial Sequence: Synthetic peptide
GVIINVKCKIAAQCLKPCKDAGMRFGACAAGKCACFGG

SEQ ID NO: 4681 - protein, 38 aa, Artificial Sequence
  Description of Artificial Sequence: Synthetic peptide
  MOD_RES (16)..(16): Orn
GVIINVKCKIAAQCLXPCKDAGMRFGACAAGKCACGGG

SEQ ID NO: 4682 - protein, 38 aa, Artificial Sequence; identical to SEQ ID NO: 4681
  Description of Artificial Sequence: Synthetic peptide
  MOD_RES (16)..(16): hLys

SEQ ID NO: 4683 - protein, 38 aa, Artificial Sequence; identical to SEQ ID NO: 4681
  Description of Artificial Sequence: Synthetic peptide
  MOD_RES (16)..(16): hArg

SEQ ID NO: 4684 - protein, 38 aa, Artificial Sequence; identical to SEQ ID NO: 4681
  Description of Artificial Sequence: Synthetic peptide
  MOD_RES (16)..(16): Cit

SEQ ID NO: 4685 - protein, 38 aa, Artificial Sequence; identical to SEQ ID NO: 4681
  Description of Artificial Sequence: Synthetic peptide
  MOD_RES (16)..(16): hCit

SEQ ID NO: 4686 - protein, 38 aa, Artificial Sequence; identical to SEQ ID NO: 4681
  Description of Artificial Sequence: Synthetic peptide
  MOD_RES (16)..(16): Dpr

SEQ ID NO: 4687 - protein, 38 aa, Artificial Sequence; identical to SEQ ID NO: 4681
  Description of Artificial Sequence: Synthetic peptide
  MOD_RES (16)..(16): Dab

SEQ ID NO: 4688 - protein, 37 aa, Artificial Sequence
  Description of Artificial Sequence: Synthetic peptide
GVIINVKCKIAAQCLKPCKDAGMRFGACAAGKCACGG

SEQ ID NO: 4689 - protein, 37 aa, Artificial Sequence; identical to SEQ ID NO: 4673
  Description of Artificial Sequence: Synthetic peptide

SEQ ID NO: 4690 - protein, 37 aa, Artificial Sequence
  Description of Artificial Sequence: Synthetic peptide
  MOD_RES (16)..(16): Orn
GVIINVKCKIAAQCLXPCKDAGMRFGACAAGKCACGG

SEQ ID NO: 4691 - protein, 38 aa, Artificial Sequence
  Description of Artificial Sequence: Synthetic peptide
  MOD_RES (16)..(16): hLys
GVIINVKCKIAAQCLXPCKEAGMRFGACAAGKCHCTPK

SEQ ID NO: 4692 - protein, 38 aa, Artificial Sequence; identical to SEQ ID NO: 4691
  Description of Artificial Sequence: Synthetic peptide
  MOD_RES (16)..(16): hArg

SEQ ID NO: 4693 - protein, 38 aa, Artificial Sequence; identical to SEQ ID NO: 4691
  Description of Artificial Sequence: Synthetic peptide
  MOD_RES (16)..(16): Cit

SEQ ID NO: 4694 - protein, 38 aa, Artificial Sequence; identical to SEQ ID NO: 4691
  Description of Artificial Sequence: Synthetic peptide
  MOD_RES (16)..(16): hCit

SEQ ID NO: 4695 - protein, 38 aa, Artificial Sequence; identical to SEQ ID NO: 4691
  Description of Artificial Sequence: Synthetic peptide
  MOD_RES (16)..(16): Dpr

SEQ ID NO: 4696 - protein, 38 aa, Artificial Sequence; identical to SEQ ID NO: 4691
  Description of Artificial Sequence: Synthetic peptide
  MOD_RES (16)..(16): Dab

SEQ ID NO: 4697 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCHCYPK

SEQ ID NO: 4698 - protein, 38 aa, Artificial Sequence; identical to SEQ ID NO: 4697
  Description of Artificial Sequence: Synthetic peptide
  MOD_RES (16)..(16): hLys

SEQ ID NO: 4699 - protein, 38 aa, Artificial Sequence; identical to SEQ ID NO: 4697
  Description of Artificial Sequence: Synthetic peptide
  MOD_RES (16)..(16): hArg

SEQ ID NO: 4700 - protein, 38 aa, Artificial Sequence; identical to SEQ ID NO: 4697
  Description of Artificial Sequence: Synthetic peptide
  MOD_RES (16)..(16): Cit

SEQ ID NO: 4701 - protein, 38 aa, Artificial Sequence; identical to SEQ ID NO: 4697
  Description of Artificial Sequence: Synthetic peptide
  MOD_RES (16)..(16): hCit

SEQ ID NO: 4702 - protein, 38 aa, Artificial Sequence; identical to SEQ ID NO: 4697
  Description of Artificial Sequence: Synthetic peptide
  MOD_RES (16)..(16): Dpr

SEQ ID NO: 4703 - protein, 38 aa, Artificial Sequence; identical to SEQ ID NO: 4697
  Description of Artificial Sequence: Synthetic peptide
  MOD_RES (16)..(16): Dab

SEQ ID NO: 4704 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCACTPK

SEQ ID NO: 4705 - protein, 38 aa, Artificial Sequence; identical to SEQ ID NO: 4704
  Description of Artificial Sequence: Synthetic peptide
  MOD_RES (16)..(16): hLys

SEQ ID NO: 4706 - protein, 38 aa, Artificial Sequence; identical to SEQ ID NO: 4704
  Description of Artificial Sequence: Synthetic peptide
  MOD_RES (16)..(16): hArg

SEQ ID NO: 4707 - protein, 38 aa, Artificial Sequence; identical to SEQ ID NO: 4704
  Description of Artificial Sequence: Synthetic peptide
  MOD_RES (16)..(16): Cit

SEQ ID NO: 4708 - protein, 38 aa, Artificial Sequence; identical to SEQ ID NO: 4691
  Description of Artificial Sequence: Synthetic peptide
  MOD_RES (16)..(16): hCit

SEQ ID NO: 4709 - protein, 38 aa, Artificial Sequence; identical to SEQ ID NO: 4704
  Description of Artificial Sequence: Synthetic peptide
  MOD_RES (16)..(16): Dpr

SEQ ID NO: 4710 - protein, 38 aa, Artificial Sequence; identical to SEQ ID NO: 4704
  Description of Artificial Sequence: Synthetic peptide
  MOD_RES (16)..(16): Dab

SEQ ID NO: 4711 - protein, 35 aa, Artificial Sequence
  Description of Artificial Sequence: Synthetic peptide
  MOD_RES (16)..(16): Orn
GVIINVKCKIAAQCLXPCKEAGMRFGACAAGKCHC

SEQ ID NO: 4712 - protein, 35 aa, Artificial Sequence; identical to SEQ ID NO: 4711
  Description of Artificial Sequence: Synthetic peptide
  MOD_RES (16)..(16): hLys

SEQ ID NO: 4713 - protein, 35 aa, Artificial Sequence; identical to SEQ ID NO: 4711
  Description of Artificial Sequence: Synthetic peptide
  MOD_RES (16)..(16): hArg

SEQ ID NO: 4714 - protein, 35 aa, Artificial Sequence; identical to SEQ ID NO: 4711
  Description of Artificial Sequence: Synthetic peptide
  MOD_RES (16)..(16): Cit

SEQ ID NO: 4715 - protein, 35 aa, Artificial Sequence; identical to SEQ ID NO: 4711
  Description of Artificial Sequence: Synthetic peptide
  MOD_RES (16)..(16): hCit

SEQ ID NO: 4716 - protein, 35 aa, Artificial Sequence; identical to SEQ ID NO: 4711
  Description of Artificial Sequence: Synthetic peptide
  MOD_RES (16)..(16): Dpr

SEQ ID NO: 4717 - protein, 35 aa, Artificial Sequence
  Description of Artificial Sequence: Synthetic peptide
  MOD_RES (16)..(16): Orn
GVIINVKCKIAAQCLXPCKEAGMRFGACAAGKCAC

SEQ ID NO: 4718 - protein, 35 aa, Artificial Sequence; identical to SEQ ID NO: 4717
  Description of Artificial Sequence: Synthetic peptide
  MOD_RES (16)..(16): hLys

SEQ ID NO: 4719 - protein, 35 aa, Artificial Sequence; identical to SEQ ID NO: 4717
  Description of Artificial Sequence: Synthetic peptide
  MOD_RES (16)..(16): hArg

SEQ ID NO: 4720 - protein, 35 aa, Artificial Sequence; identical to SEQ ID NO: 4717
  Description of Artificial Sequence: Synthetic peptide
  MOD_RES (16)..(16): Cit

SEQ ID NO: 4721 - protein, 35 aa, Artificial Sequence; identical to SEQ ID NO: 4711
  Description of Artificial Sequence: Synthetic peptide
  MOD_RES (16)..(16): hCit

SEQ ID NO: 4722 - protein, 35 aa, Artificial Sequence; identical to SEQ ID NO: 4717
  Description of Artificial Sequence: Synthetic peptide
  MOD_RES (16)..(16): Dpr

SEQ ID NO: 4723 - protein, 35 aa, Artificial Sequence; identical to SEQ ID NO: 4717
  Description of Artificial Sequence: Synthetic peptide
  MOD_RES (16)..(16): Dab

SEQ ID NO: 4724 - protein, 38 aa, Artificial Sequence
  Description of Artificial Sequence: Synthetic peptide
GVIINVKCKIAAQCLKPCKEAGMRFGACAAGKCHCYGG

SEQ ID NO: 4725 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCHCYGG

SEQ ID NO: 4726 - protein, 37 aa, Artificial Sequence
  Description of Artificial Sequence: Synthetic peptide
GVIINVKCKIAAQCLKPCKEAGMRFGACAAGKCHCYG

SEQ ID NO: 4727 - protein, 37 aa, Artificial Sequence
  Description of Artificial Sequence: Synthetic peptide
GVIINVKCKIAAQCLKPCKEAGMRFGACAAGKCACYG

SEQ ID NO: 4728 - protein, 38 aa, Artificial Sequence; identical to SEQ ID NO: 4725
  Description of Artificial Sequence: Synthetic peptide
  MOD_RES (16)..(16): hLys

SEQ ID NO: 4729 - protein, 38 aa, Artificial Sequence; identical to SEQ ID NO: 4725
  Description of Artificial Sequence: Synthetic peptide
  MOD_RES (16)..(16): hArg

SEQ ID NO: 4730 - protein, 38 aa, Artificial Sequence; identical to SEQ ID NO: 4725
  Description of Artificial Sequence: Synthetic peptide
  MOD_RES (16)..(16): Cit

SEQ ID NO: 4731 - protein, 38 aa, Artificial Sequence; identical to SEQ ID NO: 4725
  Description of Artificial Sequence: Synthetic peptide
  MOD_RES (16)..(16): hCit

SEQ ID NO: 4732 - protein, 38 aa, Artificial Sequence; identical to SEQ ID NO: 4725
  Description of Artificial Sequence: Synthetic peptide
  MOD_RES (16)..(16): Dpr

SEQ ID NO: 4733 - protein, 38 aa, Artificial Sequence; identical to SEQ ID NO: 4725
  Description of Artificial Sequence: Synthetic peptide
  MOD_RES (16)..(16): Dab

SEQ ID NO: 4734 - protein, 37 aa, Artificial Sequence; identical to SEQ ID NO: 4727
  Description of Artificial Sequence: Synthetic peptide

SEQ ID NO: 4735 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCACYGG

SEQ ID NO: 4736 - protein, 38 aa, Artificial Sequence; identical to SEQ ID NO: 4735
  Description of Artificial Sequence: Synthetic peptide
  MOD_RES (16)..(16): hLys

SEQ ID NO: 4737 - protein, 38 aa, Artificial Sequence; identical to SEQ ID NO: 4735
  Description of Artificial Sequence: Synthetic peptide
  MOD_RES (16)..(16): hArg

SEQ ID NO: 4738 - protein, 38 aa, Artificial Sequence; identical to SEQ ID NO: 4735
  Description of Artificial Sequence: Synthetic peptide
  MOD_RES (16)..(16): Cit

SEQ ID NO: 4739 - protein, 38 aa, Artificial Sequence; identical to SEQ ID NO: 4725
  Description of Artificial Sequence: Synthetic peptide
  MOD_RES (16)..(16): hCit

SEQ ID NO: 4740 - protein, 38 aa, Artificial Sequence; identical to SEQ ID NO: 4735
  Description of Artificial Sequence: Synthetic peptide
  MOD_RES (16)..(16): Dpr

SEQ ID NO: 4741 - protein, 38 aa, Artificial Sequence; identical to SEQ ID NO: 4735
  Description of Artificial Sequence: Synthetic peptide
  MOD_RES (16)..(16): Dab

SEQ ID NO: 4742 - protein, 38 aa, Artificial Sequence
  Description of Artificial Sequence: Synthetic peptide
GVIINVKCKIAAQCLKPCKEAGMRFGACAAGKCACFGG

SEQ ID NO: 4743 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCHCGGG

SEQ ID NO: 4744 - protein, 38 aa, Artificial Sequence; identical to SEQ ID NO: 4743
  Description of Artificial Sequence: Synthetic peptide
  MOD_RES (16)..(16): hLys

SEQ ID NO: 4745 - protein, 38 aa, Artificial Sequence; identical to SEQ ID NO: 4743
  Description of Artificial Sequence: Synthetic peptide
  MOD_RES (16)..(16): hArg

SEQ ID NO: 4746 - protein, 38 aa, Artificial Sequence; identical to SEQ ID NO: 4743
  Description of Artificial Sequence: Synthetic peptide
  MOD_RES (16)..(16): Cit

SEQ ID NO: 4747 - protein, 38 aa, Artificial Sequence; identical to SEQ ID NO: 4743
  Description of Artificial Sequence: Synthetic peptide
  MOD_RES (16)..(16): hCit

SEQ ID NO: 4748 - protein, 38 aa, Artificial Sequence; identical to SEQ ID NO: 4743
  Description of Artificial Sequence: Synthetic peptide
  MOD_RES (16)..(16): Dpr

SEQ ID NO: 4749 - protein, 38 aa, Artificial Sequence
  Description of Artificial Sequence: Synthetic peptide
  MOD_RES (16)..(16): Orn
GVIINVKCKIAAQCLXPCKEAGMRFGACAAGKCACGGG

SEQ ID NO: 4750 - protein, 38 aa, Artificial Sequence; identical to SEQ ID NO: 4749
  Description of Artificial Sequence: Synthetic peptide
  MOD_RES (16)..(16): hLys

SEQ ID NO: 4751 - protein, 38 aa, Artificial Sequence; identical to SEQ ID NO: 4749
  Description of Artificial Sequence: Synthetic peptide
  MOD_RES (16)..(16): hArg

SEQ ID NO: 4752 - protein, 38 aa, Artificial Sequence; identical to SEQ ID NO: 4749
  Description of Artificial Sequence: Synthetic peptide
  MOD_RES (16)..(16): Cit

SEQ ID NO: 4753 - protein, 37 aa, Artificial Sequence
  Description of Artificial Sequence: Synthetic peptide
  MOD_RES (16)..(16): hCit
GVIINVKCKIAAQCLXPCKEAGMRFGACAAGKCACTP

SEQ ID NO: 4754 - protein, 37 aa, Artificial Sequence; identical to SEQ ID NO: 4753
  Description of Artificial Sequence: Synthetic peptide
  MOD_RES (16)..(16): Dpr

SEQ ID NO: 4755 - protein, 37 aa, Artificial Sequence; identical to SEQ ID NO: 4753
  Description of Artificial Sequence: Synthetic peptide
  MOD_RES (16)..(16): Dab

SEQ ID NO: 4756 - protein, 38 aa, Artificial Sequence; identical to SEQ ID NO: 4618
  Description of Artificial Sequence: Synthetic peptide
  MOD_RES (16)..(16): Orn
  c-term amidation

SEQ ID NO: 4757 - protein, 38 aa, Artificial Sequence; identical to SEQ ID NO: 4618
  Description of Artificial Sequence: Synthetic peptide
  MOD_RES (16)..(16): hLys
  c-term amidation

SEQ ID NO: 4758 - protein, 38 aa, Artificial Sequence; identical to SEQ ID NO: 4618
  Description of Artificial Sequence: Synthetic peptide
  MOD_RES (16)..(16): hArg
  c-term amidation

SEQ ID NO: 4759 - protein, 38 aa, Artificial Sequence; identical to SEQ ID NO: 4618
  Description of Artificial Sequence: Synthetic peptide
  MOD_RES (16)..(16): Cit
  c-term amidation

SEQ ID NO: 4760 - protein, 38 aa, Artificial Sequence; identical to SEQ ID NO: 4618
  Description of Artificial Sequence: Synthetic peptide
  MOD_RES (16)..(16): hCit
  c-term amidation

SEQ ID NO: 4761 - protein, 38 aa, Artificial Sequence; identical to SEQ ID NO: 4618
  Description of Artificial Sequence: Synthetic peptide
  MOD_RES (16)..(16): Dpr
  c-term amidation

SEQ ID NO: 4762 - protein, 38 aa, Artificial Sequence; identical to SEQ ID NO: 4618
  Description of Artificial Sequence: Synthetic peptide
  MOD_RES (16)..(16): Dab
  c-term amidation

SEQ ID NO: 4763 - protein, 38 aa, Artificial Sequence; identical to SEQ ID NO: 4625
  Description of Artificial Sequence: Synthetic peptide
  MOD_RES (16)..(16): Orn
  c-term amidation

SEQ ID NO: 4764 - protein, 38 aa, Artificial Sequence; identical to SEQ ID NO: 4625
  Description of Artificial Sequence: Synthetic peptide
  MOD_RES (16)..(16): hLys
  c-term amidation

SEQ ID NO: 4765 - protein, 38 aa, Artificial Sequence; identical to SEQ ID NO: 4625
  Description of Artificial Sequence: Synthetic peptide
  MOD_RES (16)..(16): hArg
  c-term amidation

SEQ ID NO: 4766 - protein, 38 aa, Artificial Sequence; identical to SEQ ID NO: 4625
  Description of Artificial Sequence: Synthetic peptide
  MOD_RES (16)..(16): Cit
  c-term amidation

SEQ ID NO: 4767 - protein, 38 aa, Artificial Sequence; identical to SEQ ID NO: 4625
  Description of Artificial Sequence: Synthetic peptide
  MOD_RES (16)..(16): hCit
  c-term amidation

SEQ ID NO: 4768 - protein, 38 aa, Artificial Sequence; identical to SEQ ID NO: 4625
  Description of Artificial Sequence: Synthetic peptide
  MOD_RES (16)..(16): Dpr
  c-term amidation

SEQ ID NO: 4769 - protein, 38 aa, Artificial Sequence; identical to SEQ ID NO: 4625
  Description of Artificial Sequence: Synthetic peptide
  MOD_RES (16)..(16): Dab
  c-term amidation

SEQ ID NO: 4770 - protein, 38 aa, Artificial Sequence; identical to SEQ ID NO: 4637
  Description of Artificial Sequence: Synthetic peptide
  MOD_RES (16)..(16): Orn
  c-term amidation

SEQ ID NO: 4771 - protein, 38 aa, Artificial Sequence; identical to SEQ ID NO: 4637
  Description of Artificial Sequence: Synthetic peptide
  MOD_RES (16)..(16): hLys
  c-term amidation

SEQ ID NO: 4772 - protein, 38 aa, Artificial Sequence; identical to SEQ ID NO: 4637
  Description of Artificial Sequence: Synthetic peptide
  MOD_RES (16)..(16): hArg
  c-term amidation

SEQ ID NO: 4773 - protein, 38 aa, Artificial Sequence; identical to SEQ ID NO: 4637
  Description of Artificial Sequence: Synthetic peptide
  MOD_RES (16)..(16): Cit
  c-term amidation

SEQ ID NO: 4774 - protein, 38 aa, Artificial Sequence; identical to SEQ ID NO: 4637
  Description of Artificial Sequence: Synthetic peptide
  MOD_RES (16)..(16): hCit
  c-term amidation

SEQ ID NO: 4775 - protein, 38 aa, Artificial Sequence; identical to SEQ ID NO: 4637
  Description of Artificial Sequence: Synthetic peptide
  MOD_RES (16)..(16): Dpr
  c-term amidation

SEQ ID NO: 4776 - protein, 38 aa, Artificial Sequence; identical to SEQ ID NO: 4637
  Description of Artificial Sequence: Synthetic peptide
  MOD_RES (16)..(16): Dab
  c-term amidation

SEQ ID NO: 4777 - protein, 35 aa, Artificial Sequence; identical to SEQ ID NO: 4644
  Description of Artificial Sequence: Synthetic peptide
  MOD_RES (16)..(16): Orn
  c-term amidation

SEQ ID NO: 4778 - protein, 35 aa, Artificial Sequence; identical to SEQ ID NO: 4644
  Description of Artificial Sequence: Synthetic peptide
  MOD_RES (16)..(16): hLys
  c-term amidation

SEQ ID NO: 4779 - protein, 35 aa, Artificial Sequence; identical to SEQ ID NO: 4644
  Description of Artificial Sequence: Synthetic peptide
  MOD_RES (16)..(16): hArg
  c-term amidation

SEQ ID NO: 4780 - protein, 35 aa, Artificial Sequence; identical to SEQ ID NO: 4644
  Description of Artificial Sequence: Synthetic peptide
  MOD_RES (16)..(16): Cit
  c-term amidation

SEQ ID NO: 4781 - protein, 35 aa, Artificial Sequence; identical to SEQ ID NO: 4644
  Description of Artificial Sequence: Synthetic peptide
  MOD_RES (16)..(16): hCit
  c-term amidation

SEQ ID NO: 4782 - protein, 35 aa, Artificial Sequence; identical to SEQ ID NO: 4644
  Description of Artificial Sequence: Synthetic peptide
  MOD_RES (16)..(16): Dpr
  c-term amidation

SEQ ID NO: 4783 - protein, 33 aa, Artificial Sequence
  Description of Artificial Sequence: Synthetic peptide
  MOD_RES (16)..(16): Orn
  c-term amidation
GVIINVKCKIAAQCLXPCKDAGMRFGACAAGKC

SEQ ID NO: 4784 - protein, 33 aa, Artificial Sequence; identical to SEQ ID NO: 4783
  Description of Artificial Sequence: Synthetic peptide
  MOD_RES (16)..(16): hLys
  c-term amidation

SEQ ID NO: 4785 - protein, 33 aa, Artificial Sequence; identical to SEQ ID NO: 4783
  Description of Artificial Sequence: Synthetic peptide
  MOD_RES (16)..(16): hArg
  c-term amidation

SEQ ID NO: 4786 - protein, 33 aa, Artificial Sequence; identical to SEQ ID NO: 4783
  Description of Artificial Sequence: Synthetic peptide
  MOD_RES (16)..(16): Cit
  c-term amidation

SEQ ID NO: 4787 - protein, 35 aa, Artificial Sequence; identical to SEQ ID NO: 4644
  Description of Artificial Sequence: Synthetic peptide
  MOD_RES (16)..(16): hCit
  c-term amidation

SEQ ID NO: 4788 - protein, 33 aa, Artificial Sequence; identical to SEQ ID NO: 4783
  Description of Artificial Sequence: Synthetic peptide
  MOD_RES (16)..(16): Dpr
  c-term amidation

SEQ ID NO: 4789 - protein, 33 aa, Artificial Sequence; identical to SEQ ID NO: 4783
  Description of Artificial Sequence: Synthetic peptide
  MOD_RES (16)..(16): Dab
  c-term amidation

SEQ ID NO: 4790 - protein, 38 aa, Artificial Sequence
  Description of Artificial Sequence: Synthetic peptide
  c-term amidation
GVIINVKCKIAAQCLKPCKDAGMRFGACAAGKCHCYGG

SEQ ID NO: 4791 - protein, 38 aa, Artificial Sequence; identical to SEQ ID NO: 4659
  Description of Artificial Sequence: Synthetic peptide
  MOD_RES (16)..(16): Orn
  c-term amidation

SEQ ID NO: 4792 - protein, 38 aa, Artificial Sequence; identical to SEQ ID NO: 4659
  Description of Artificial Sequence: Synthetic peptide
  MOD_RES (16)..(16): hLys
  c-term amidation

SEQ ID NO: 4793 - protein, 38 aa, Artificial Sequence; identical to SEQ ID NO: 4659
  Description of Artificial Sequence: Synthetic peptide
  MOD_RES (16)..(16): hArg
  c-term amidation

SEQ ID NO: 4794 - protein, 38 aa, Artificial Sequence; identical to SEQ ID NO: 4659
  Description of Artificial Sequence: Synthetic peptide
  MOD_RES (16)..(16): Cit
  c-term amidation

SEQ ID NO: 4795 - protein, 38 aa, Artificial Sequence; identical to SEQ ID NO: 4659
  Description of Artificial Sequence: Synthetic peptide
  MOD_RES (16)..(16): hCit
  c-term amidation

SEQ ID NO: 4796 - protein, 38 aa, Artificial Sequence; identical to SEQ ID NO: 4659
  Description of Artificial Sequence: Synthetic peptide
  MOD_RES (16)..(16): Dpr
  c-term amidation

SEQ ID NO: 4797 - protein, 38 aa, Artificial Sequence
  Description of Artificial Sequence: Synthetic peptide
  c-term amidation
GVIINVKCKIAAQCLKPCKDAGMRFGACAAGKCHCFGG

SEQ ID NO: 4798 - protein, 37 aa, Artificial Sequence
  Description of Artificial Sequence: Synthetic peptide
  c-term amidation
GVIINVKCKIAAQCLKPCKDAGMRFGACAAGKCHCYG

SEQ ID NO: 4799 - protein, 37 aa, Artificial Sequence; identical to SEQ ID NO: 4673
  Description of Artificial Sequence: Synthetic peptide
  c-term amidation

SEQ ID NO: 4800 - protein, 38 aa, Artificial Sequence; identical to SEQ ID NO: 4666
  Description of Artificial Sequence: Synthetic peptide
  MOD_RES (16)..(16): Orn
  c-term amidation

SEQ ID NO: 4801 - protein, 38 aa, Artificial Sequence; identical to SEQ ID NO: 4666
  Description of Artificial Sequence: Synthetic peptide
  MOD_RES (16)..(16): hLys
  c-term amidation

SEQ ID NO: 4802 - protein, 38 aa, Artificial Sequence; identical to SEQ ID NO: 4666
  Description of Artificial Sequence: Synthetic peptide
  MOD_RES (16)..(16): hArg
  c-term amidation

SEQ ID NO: 4803 - protein, 38 aa, Artificial Sequence; identical to SEQ ID NO: 4666
  Description of Artificial Sequence: Synthetic peptide
  MOD_RES (16)..(16): Cit
  c-term amidation

SEQ ID NO: 4804 - protein, 38 aa, Artificial Sequence; identical to SEQ ID NO: 4666
  Description of Artificial Sequence: Synthetic peptide
  MOD_RES (16)..(16): hCit
  c-term amidation

SEQ ID NO: 4805 - protein, 38 aa, Artificial Sequence; identical to SEQ ID NO: 4666
  Description of Artificial Sequence: Synthetic peptide
  MOD_RES (16)..(16): Dpr
  c-term amidation

SEQ ID NO: 4806 - protein, 38 aa, Artificial Sequence; identical to SEQ ID NO: 4666
  Description of Artificial Sequence: Synthetic peptide
  MOD_RES (16)..(16): Dab
  c-term amidation

SEQ ID NO: 4807 - protein, 38 aa, Artificial Sequence; identical to SEQ ID NO: 4665
  Description of Artificial Sequence: Synthetic peptide
  c-term amidation

SEQ ID NO: 4808 - protein, 38 aa, Artificial Sequence; identical to SEQ ID NO: 4674
  Description of Artificial Sequence: Synthetic peptide
  MOD_RES (16)..(16): Orn
  c-term amidation

SEQ ID NO: 4809 - protein, 38 aa, Artificial Sequence; identical to SEQ ID NO: 4674
  Description of Artificial Sequence: Synthetic peptide
  MOD_RES (16)..(16): hLys
  c-term amidation

SEQ ID NO: 4810 - protein, 38 aa, Artificial Sequence; identical to SEQ ID NO: 4674
  Description of Artificial Sequence: Synthetic peptide
  MOD_RES (16)..(16): hArg
  c-term amidation

SEQ ID NO: 4811 - protein, 38 aa, Artificial Sequence; identical to SEQ ID NO: 4674
  Description of Artificial Sequence: Synthetic peptide
  MOD_RES (16)..(16): Cit
  c-term amidation

SEQ ID NO: 4812 - protein, 38 aa, Artificial Sequence; identical to SEQ ID NO: 4674
  Description of Artificial Sequence: Synthetic peptide
  MOD_RES (16)..(16): hCit
  c-term amidation

SEQ ID NO: 4813 - protein, 38 aa, Artificial Sequence; identical to SEQ ID NO: 4674
  Description of Artificial Sequence: Synthetic peptide
  MOD_RES (16)..(16): Dpr
  c-term amidation

SEQ ID NO: 4814 - protein, 38 aa, Artificial Sequence
  Description of Artificial Sequence: Synthetic peptide
  c-term amidation
GVIINVKCKIAAQCLKPCKDAGMRFGACAAGKCACGGG

SEQ ID NO: 4815 - protein, 38 aa, Artificial Sequence
  Description of Artificial Sequence: Synthetic peptide
  MOD_RES (16)..(16): Orn
  c-term amidation
GVIINVKCKIAAQCLXPCKDAGMRFGACAAGKCACFGG

SEQ ID NO: 4816 - protein, 38 aa, Artificial Sequence; identical to SEQ ID NO: 4681
  Description of Artificial Sequence: Synthetic peptide
  MOD_RES (16)..(16): Orn
  c-term amidation

SEQ ID NO: 4817 - protein, 38 aa, Artificial Sequence; identical to SEQ ID NO: 4681
  Description of Artificial Sequence: Synthetic peptide
  MOD_RES (16)..(16): hLys
  c-term amidation

SEQ ID NO: 4818 - protein, 38 aa, Artificial Sequence; identical to SEQ ID NO: 4681
  Description of Artificial Sequence: Synthetic peptide
  MOD_RES (16)..(16): hArg
  c-term amidation

SEQ ID NO: 4819 - protein, 38 aa, Artificial Sequence; identical to SEQ ID NO: 4681
  Description of Artificial Sequence: Synthetic peptide
  MOD_RES (16)..(16): Cit
  c-term amidation

SEQ ID NO: 4820 - protein, 38 aa, Artificial Sequence; identical to SEQ ID NO: 4681
  Description of Artificial Sequence: Synthetic peptide
  MOD_RES (16)..(16): hCit
  c-term amidation

SEQ ID NO: 4821 - protein, 38 aa, Artificial Sequence; identical to SEQ ID NO: 4681
  Description of Artificial Sequence: Synthetic peptide
  MOD_RES (16)..(16): Dpr
  c-term amidation

SEQ ID NO: 4822 - protein, 38 aa, Artificial Sequence; identical to SEQ ID NO: 4681
  Description of Artificial Sequence: Synthetic peptide
  MOD_RES (16)..(16): Dab
  c-term amidation

SEQ ID NO: 4823 - protein, 38 aa, Artificial Sequence; identical to SEQ ID NO: 4691
  Description of Artificial Sequence: Synthetic peptide
  MOD_RES (16)..(16): Orn
  c-term amidation

SEQ ID NO: 4824 - protein, 38 aa, Artificial Sequence; identical to SEQ ID NO: 4691
  Description of Artificial Sequence: Synthetic peptide
  MOD_RES (16)..(16): hLys
  c-term amidation

SEQ ID NO: 4825 - protein, 38 aa, Artificial Sequence; identical to SEQ ID NO: 4691
  Description of Artificial Sequence: Synthetic peptide
  MOD_RES (16)..(16): hArg
  c-term amidation

SEQ ID NO: 4826 - protein, 38 aa, Artificial Sequence; identical to SEQ ID NO: 4691
  Description of Artificial Sequence: Synthetic peptide
  MOD_RES (16)..(16): Cit
  c-term amidation

SEQ ID NO: 4827 - protein, 38 aa, Artificial Sequence; identical to SEQ ID NO: 4691
  Description of Artificial Sequence: Synthetic peptide
  MOD_RES (16)..(16): hCit
  c-term amidation

SEQ ID NO: 4828 - protein, 38 aa, Artificial Sequence; identical to SEQ ID NO: 4691
  Description of Artificial Sequence: Synthetic peptide
  MOD_RES (16)..(16): Dpr
  c-term amidation

SEQ ID NO: 4829 - protein, 38 aa, Artificial Sequence; identical to SEQ ID NO: 4691
  Description of Artificial Sequence: Synthetic peptide
  MOD_RES (16)..(16): Dab
  c-term amidation

SEQ ID NO: 4830 - protein, 38 aa, Artificial Sequence; identical to SEQ ID NO: 4697
  Description of Artificial Sequence: Synthetic peptide
  MOD_RES (16)..(16): Orn
  c-term amidation

SEQ ID NO: 4831 - protein, 38 aa, Artificial Sequence; identical to SEQ ID NO: 4697
  Description of Artificial Sequence: Synthetic peptide
  MOD_RES (16)..(16): hLys
  c-term amidation

SEQ ID NO: 4832 - protein, 38 aa, Artificial Sequence; identical to SEQ ID NO: 4697
  Description of Artificial Sequence: Synthetic peptide
  MOD_RES (16)..(16): hArg
  c-term amidation

SEQ ID NO: 4833 - protein, 38 aa, Artificial Sequence; identical to SEQ ID NO: 4697
  Description of Artificial Sequence: Synthetic peptide
  MOD_RES (16)..(16): Cit
  c-term amidation

SEQ ID NO: 4834 - protein, 38 aa, Artificial Sequence; identical to SEQ ID NO: 4697
  Description of Artificial Sequence: Synthetic peptide
  MOD_RES (16)..(16): hCit
  c-term amidation

SEQ ID NO: 4835 - protein, 38 aa, Artificial Sequence; identical to SEQ ID NO: 4697
  Description of Artificial Sequence: Synthetic peptide
  MOD_RES (16)..(16): Dpr
  c-term amidation

SEQ ID NO: 4836 - protein, 38 aa, Artificial Sequence; identical to SEQ ID NO: 4697
  Description of Artificial Sequence: Synthetic peptide
  MOD_RES (16)..(16): Dab
  c-term amidation

SEQ ID NO: 4837 - protein, 38 aa, Artificial Sequence; identical to SEQ ID NO: 4704
  Description of Artificial Sequence: Synthetic peptide
  MOD_RES (16)..(16): Orn
  c-term amidation

SEQ ID NO: 4838 - protein, 38 aa, Artificial Sequence; identical to SEQ ID NO: 4704
  Description of Artificial Sequence: Synthetic peptide
  MOD_RES (16)..(16): hLys
  c-term amidation

SEQ ID NO: 4839 - protein, 38 aa, Artificial Sequence; identical to SEQ ID NO: 4704
  Description of Artificial Sequence: Synthetic peptide
  MOD_RES (16)..(16): hArg
  c-term amidation

SEQ ID NO: 4840 - protein, 38 aa, Artificial Sequence; identical to SEQ ID NO: 4704
  Description of Artificial Sequence: Synthetic peptide
  MOD_RES (16)..(16): Cit
  c-term amidation

SEQ ID NO: 4841 - protein, 38 aa, Artificial Sequence; identical to SEQ ID NO: 4704
  Description of Artificial Sequence: Synthetic peptide
  MOD_RES (16)..(16): hCit
  c-term amidation

SEQ ID NO: 4842 - protein, 38 aa, Artificial Sequence; identical to SEQ ID NO: 4704
  Description of Artificial Sequence: Synthetic peptide
  MOD_RES (16)..(16): Dpr
  c-term amidation

SEQ ID NO: 4843 - protein, 38 aa, Artificial Sequence; identical to SEQ ID NO: 4704
  Description of Artificial Sequence: Synthetic peptide
  MOD_RES (16)..(16): Dab
  c-term amidation

SEQ ID NO: 4844 - protein, 35 aa, Artificial Sequence; identical to SEQ ID NO: 4711
  Description of Artificial Sequence: Synthetic peptide
  MOD_RES (16)..(16): Orn
  c-term amidation

SEQ ID NO: 4845 - protein, 35 aa, Artificial Sequence; identical to SEQ ID NO: 4711
  Description of Artificial Sequence: Synthetic peptide
  MOD_RES (16)..(16): hLys
  c-term amidation

SEQ ID NO: 4846 - protein, 35 aa, Artificial Sequence; identical to SEQ ID NO: 4711
  Description of Artificial Sequence: Synthetic peptide
  MOD_RES (16)..(16): hArg
  c-term amidation

SEQ ID NO: 4847 - protein, 35 aa, Artificial Sequence; identical to SEQ ID NO: 4711
  Description of Artificial Sequence: Synthetic peptide
  MOD_RES (16)..(16): Cit
  c-term amidation

SEQ ID NO: 4848 - protein, 35 aa, Artificial Sequence; identical to SEQ ID NO: 4711
  Description of Artificial Sequence: Synthetic peptide
  MOD_RES (16)..(16): hCit
  c-term amidation

SEQ ID NO: 4849 - protein, 35 aa, Artificial Sequence; identical to SEQ ID NO: 4711
  Description of Artificial Sequence: Synthetic peptide
  MOD_RES (16)..(16): Dpr
  c-term amidation

SEQ ID NO: 4850 - protein, 33 aa, Artificial Sequence
  Description of Artificial Sequence: Synthetic peptide
  MOD_RES (16)..(16): Orn
  c-term amidation
GVIINVKCKIAAQCLXPCKEAGMRFGACAAGKC

SEQ ID NO: 4851 - protein, 33 aa, Artificial Sequence; identical to SEQ ID NO: 4850
  Description of Artificial Sequence: Synthetic peptide
  MOD_RES (16)..(16): hLys
  c-term amidation

SEQ ID NO: 4852 - protein, 33 aa, Artificial Sequence; identical to SEQ ID NO: 4850
  Description of Artificial Sequence: Synthetic peptide
  MOD_RES (16)..(16): hArg
  c-term amidation

SEQ ID NO: 4853 - protein, 33 aa, Artificial Sequence; identical to SEQ ID NO: 4850
  Description of Artificial Sequence: Synthetic peptide
  MOD_RES (16)..(16): Cit
  c-term amidation

SEQ ID NO: 4854 - protein, 35 aa, Artificial Sequence; identical to SEQ ID NO: 4711
  Description of Artificial Sequence: Synthetic peptide
  MOD_RES (16)..(16): hCit
  c-term amidation

SEQ ID NO: 4855 - protein, 33 aa, Artificial Sequence; identical to SEQ ID NO: 4850
  Description of Artificial Sequence: Synthetic peptide
  MOD_RES (16)..(16): Dpr
  c-term amidation

SEQ ID NO: 4856 - protein, 33 aa, Artificial Sequence; identical to SEQ ID NO: 4850
  Description of Artificial Sequence: Synthetic peptide
  MOD_RES (16)..(16): Dab
  c-term amidation

SEQ ID NO: 4857 - protein, 38 aa, Artificial Sequence
  Description of Artificial Sequence: Synthetic peptide
  c-term amidation
GVIINVKCKIAAQCLKPCKEAGMRFGACAAGKCHCWGG

SEQ ID NO: 4858 - protein, 38 aa, Artificial Sequence; identical to SEQ ID NO: 4725
  Description of Artificial Sequence: Synthetic peptide
  MOD_RES (16)..(16): Orn
  c-term amidation

SEQ ID NO: 4859 - protein, 38 aa, Artificial Sequence; identical to SEQ ID NO: 4725
  Description of Artificial Sequence: Synthetic peptide
  MOD_RES (16)..(16): hLys
  c-term amidation

SEQ ID NO: 4860 - protein, 38 aa, Artificial Sequence; identical to SEQ ID NO: 4725
  Description of Artificial Sequence: Synthetic peptide
  MOD_RES (16)..(16): hArg
  c-term amidation

SEQ ID NO: 4861 - protein, 38 aa, Artificial Sequence; identical to SEQ ID NO: 4725
  Description of Artificial Sequence: Synthetic peptide
  MOD_RES (16)..(16): Cit
  c-term amidation

SEQ ID NO: 4862 - protein, 38 aa, Artificial Sequence; identical to SEQ ID NO: 4725
  Description of Artificial Sequence: Synthetic peptide
  MOD_RES (16)..(16): hCit
  c-term amidation

SEQ ID NO: 4863 - protein, 38 aa, Artificial Sequence; identical to SEQ ID NO: 4725
  Description of Artificial Sequence: Synthetic peptide
  MOD_RES (16)..(16): Dpr
  c-term amidation

SEQ ID NO: 4864 - protein, 38 aa, Artificial Sequence; identical to SEQ ID NO: 4725
  Description of Artificial Sequence: Synthetic peptide
  MOD_RES (16)..(16): Dab
  c-term amidation

SEQ ID NO: 4865 - protein, 38 aa, Artificial Sequence
  Description of Artificial Sequence: Synthetic peptide
  c-term amidation
GVIINVKCKIAAQCLKPCKEAGMRFGACAAGKCACYGG

SEQ ID NO: 4866 - protein, 38 aa, Artificial Sequence; identical to SEQ ID NO: 4735
  Description of Artificial Sequence: Synthetic peptide
  MOD_RES (16)..(16): Orn
  c-term amidation

SEQ ID NO: 4867 - protein, 38 aa, Artificial Sequence; identical to SEQ ID NO: 4735
  Description of Artificial Sequence: Synthetic peptide
  MOD_RES (16)..(16): hLys
  c-term amidation

SEQ ID NO: 4868 - protein, 38 aa, Artificial Sequence; identical to SEQ ID NO: 4735
  Description of Artificial Sequence: Synthetic peptide
  MOD_RES (16)..(16): hArg
  c-term amidation

SEQ ID NO: 4869 - protein, 38 aa, Artificial Sequence; identical to SEQ ID NO: 4735
  Description of Artificial Sequence: Synthetic peptide
  MOD_RES (16)..(16): Cit
  c-term amidation

SEQ ID NO: 4870 - protein, 38 aa, Artificial Sequence; identical to SEQ ID NO: 4725
  Description of Artificial Sequence: Synthetic peptide
  MOD_RES (16)..(16): hCit
  c-term amidation

SEQ ID NO: 4871 - protein, 38 aa, Artificial Sequence; identical to SEQ ID NO: 4735
  Description of Artificial Sequence: Synthetic peptide
  MOD_RES (16)..(16): Dpr
  c-term amidation

SEQ ID NO: 4872 - protein, 38 aa, Artificial Sequence; identical to SEQ ID NO: 4735
  Description of Artificial Sequence: Synthetic peptide
  MOD_RES (16)..(16): Dab
  c-term amidation

SEQ ID NO: 4873 - protein, 38 aa, Artificial Sequence; identical to SEQ ID NO: 4743
  Description of Artificial Sequence: Synthetic peptide
  MOD_RES (16)..(16): Orn
  c-term amidation

SEQ ID NO: 4874 - protein, 38 aa, Artificial Sequence; identical to SEQ ID NO: 4743
  Description of Artificial Sequence: Synthetic peptide
  MOD_RES (16)..(16): hLys
  c-term amidation

SEQ ID NO: 4875 - protein, 38 aa, Artificial Sequence; identical to SEQ ID NO: 4743
  Description of Artificial Sequence: Synthetic peptide
  MOD_RES (16)..(16): hArg
  c-term amidation

SEQ ID NO: 4876 - protein, 38 aa, Artificial Sequence; identical to SEQ ID NO: 4743
  Description of Artificial Sequence: Synthetic peptide
  MOD_RES (16)..(16): Cit
  c-term amidation

SEQ ID NO: 4877 - protein, 38 aa, Artificial Sequence; identical to SEQ ID NO: 4743
  Description of Artificial Sequence: Synthetic peptide
  MOD_RES (16)..(16): hCit
  c-term amidation

SEQ ID NO: 4878 - protein, 38 aa, Artificial Sequence; identical to SEQ ID NO: 4743
  Description of Artificial Sequence: Synthetic peptide
  MOD_RES (16)..(16): Dpr
  c-term amidation

SEQ ID NO: 4879 - protein, 38 aa, Artificial Sequence; identical to SEQ ID NO: 4749
  Description of Artificial Sequence: Synthetic peptide
  MOD_RES (16)..(16): Orn
  c-term amidation

SEQ ID NO: 4880 - protein, 38 aa, Artificial Sequence; identical to SEQ ID NO: 4749
  Description of Artificial Sequence: Synthetic peptide
  MOD_RES (16)..(16): hLys
  c-term amidation

SEQ ID NO: 4881 - protein, 38 aa, Artificial Sequence; identical to SEQ ID NO: 4749
  Description of Artificial Sequence: Synthetic peptide
  MOD_RES (16)..(16): hArg
  c-term amidation

SEQ ID NO: 4882 - protein, 38 aa, Artificial Sequence; identical to SEQ ID NO: 4749
  Description of Artificial Sequence: Synthetic peptide
  MOD_RES (16)..(16): Cit
  c-term amidation

SEQ ID NO: 4883 - protein, 37 aa, Artificial Sequence; identical to SEQ ID NO: 4753
  Description of Artificial Sequence: Synthetic peptide
  MOD_RES (16)..(16): hCit
  c-term amidation

SEQ ID NO: 4884 - protein, 38 aa, Artificial Sequence; identical to SEQ ID NO: 4749
  Description of Artificial Sequence: Synthetic peptide
  MOD_RES (16)..(16): Dpr
  c-term amidation

SEQ ID NO: 4885 - protein, 38 aa, Artificial Sequence; identical to SEQ ID NO: 4749
  Description of Artificial Sequence: Synthetic peptide
  MOD_RES (16)..(16): Dab
  c-term amidation

SEQ ID NO: 4886 - protein, 38 aa, Artificial Sequence
  Description of Artificial Sequence: Synthetic peptide
  MOD_RES (20)..(20): Cpa
  c-term amidation
GVIINVKCKIAAQCLKPCKXAGMRFGACAAGKCACYGG

SEQ ID NO: 4887 - protein, 38 aa, Artificial Sequence
  Description of Artificial Sequence: Synthetic peptide
  MOD_RES (20)..(20): Cpa
  c-term amidation
GVIINVKCKIAAQCLKPCKXAGMRFGACAAGKCACGGG

SEQ ID NO: 4888 - protein, 36 aa, Artificial Sequence
  Description of Artificial Sequence: Synthetic peptide
  MOD_RES (20)..(20): Cpa
  c-term amidation
GVIINVKCKIAAQCLKPCKXAGMRFGACAAGKCACY

SEQ ID NO: 4889 - protein, 38 aa, Artificial Sequence; identical to SEQ ID NO: 4665
  Description of Artificial Sequence: Synthetic peptide
  n-term acetylation
  c-term amidation

SEQ ID NO: 4890 - protein, 38 aa, Artificial Sequence; identical to SEQ ID NO: 4886
  Description of Artificial Sequence: Synthetic peptide
  MOD_RES (20)..(20): Aad
  c-term amidation

SEQ ID NO: 4891 - protein, 38 aa, Artificial Sequence
  Description of Artificial Sequence: Synthetic peptide
  MOD_RES (20)..(20): Aad
  c-term amidation
GVIINVKCKIAAQCLKPCKXAGMRFGACAAGKCHCYGG

SEQ ID NO: 4892 - protein, 38 aa, Artificial Sequence; identical to SEQ ID NO: 4886
  Description of Artificial Sequence: Synthetic peptide
  MOD_RES (20)..(20): Aad

SEQ ID NO: 4893 - protein, 38 aa, Artificial Sequence
  Description of Artificial Sequence: Synthetic peptide
  c-term amidation
GVIINVKCKIAAQCLHPCKDAGMRFGACAAGKCACYGG

SEQ ID NO: 4894 - protein, 38 aa, Artificial Sequence; identical to SEQ ID NO: 4893
  Description of Artificial Sequence: Synthetic peptide

SEQ ID NO: 4895 - protein, 36 aa, Artificial Sequence
  Description of Artificial Sequence: Synthetic peptide
  c-term amidation
GVIINVKCKIAAQCLHPCKDAGMRFGACAAGKCACY

SEQ ID NO: 4896 - protein, 38 aa, Artificial Sequence
  Description of Artificial Sequence: Synthetic peptide
  c-term amidation
GVIINVKCKIAAQCLHPCKDAGMRFGACAAGKCHCYGG

SEQ ID NO: 4897 - protein, 38 aa, Artificial Sequence; identical to SEQ ID NO: 4896
  Description of Artificial Sequence: Synthetic peptide

SEQ ID NO: 4898 - protein, 38 aa, Artificial Sequence
  Description of Artificial Sequence: Synthetic peptide
GVIINVKCKIAAQCLHPCKDAGMRFGACAAGKCHCYPK

SEQ ID NO: 4899 - protein, 35 aa, Artificial Sequence
  Description of Artificial Sequence: Synthetic peptide
GVIINVKCKIAAQCLHPCKDAGMRFGACAAGKCAC

SEQ ID NO: 4900 - protein, 38 aa, Artificial Sequence
  Description of Artificial Sequence: Synthetic peptide
  MOD_RES (36)..(36): 1Nal
  c-term amidation
GVIINVKCKIAAQCLKPCKDAGMRFGACAAGKCACXGG

SEQ ID NO: 4901 - protein, 38 aa, Artificial Sequence
  Description of Artificial Sequence: Synthetic peptide
  MOD_RES (36)..(36): 1Nal
  c-term amidation
GVIINVKCKIAAQCLKPCKDAGMRFGACAAGKCACXPK

SEQ ID NO: 4902 - protein, 38 aa, Artificial Sequence; identical to SEQ ID NO: 4900
  Description of Artificial Sequence: Synthetic peptide
  MOD_RES (36)..(36): 2Nal
  c-term amidation

SEQ ID NO: 4903 - protein, 38 aa, Artificial Sequence; identical to SEQ ID NO: 4900
  Description of Artificial Sequence: Synthetic peptide
  MOD_RES (36)..(36): Cha
  c-term amidation

SEQ ID NO: 4904 - protein, 38 aa, Artificial Sequence; identical to SEQ ID NO: 4900
  Description of Artificial Sequence: Synthetic peptide
  MOD_RES (36)..(36): MePhe
  c-term amidation

SEQ ID NO: 4905 - protein, 38 aa, Artificial Sequence; identical to SEQ ID NO: 4900
  Description of Artificial Sequence: Synthetic peptide
  MOD_RES (36)..(36): BiPhA
  c-term amidation

SEQ ID NO: 4906 - protein, 38 aa, Artificial Sequence
  Description of Artificial Sequence: Synthetic peptide
  MOD_RES (34)..(34): Aib
  c-term amidation
GVIINVKCKIAAQCLKPCKDAGMRFGACAAGKCXCYGG

SEQ ID NO: 4907 - protein, 38 aa, Artificial Sequence; identical to SEQ ID NO: 4906
  Description of Artificial Sequence: Synthetic peptide
  MOD_RES (34)..(34): Abu
  c-term amidation

SEQ ID NO: 4908 - protein, 36 aa, Artificial Sequence
  Description of Artificial Sequence: Synthetic peptide
  MOD_RES (36)..(36): 1Nal
GVIINVKCKIAAQCLKPCKDAGMRFGACAAGKCACX

SEQ ID NO: 4909 - protein, 38 aa, Artificial Sequence
  Description of Artificial Sequence: Synthetic peptide
  MOD_RES (36)..(36): 1Nal
  c-term amidation
GVIINVKCKIAAQCLHPCKDAGMRFGACAAGKCACXGG

SEQ ID NO: 4910 - protein, 36 aa, Artificial Sequence; identical to SEQ ID NO: 4908
  Description of Artificial Sequence: Synthetic peptide
  MOD_RES (36)..(36): 4Bip
  c-term amidation

SEQ ID NO: 4911 - protein, 38 aa, Artificial Sequence; identical to SEQ ID NO: 4909
  Description of Artificial Sequence: Synthetic peptide
  MOD_RES (36)..(36): 4Bip
  c-term amidation

SEQ ID NO: 4912 - protein, 38 aa, Artificial Sequence
  Description of Artificial Sequence: Synthetic peptide
GVIINVKCKIAAQCLKPCKDAGMRFGACAAGKCHCGGG

SEQ ID NO: 4913 - protein, 38 aa, Artificial Sequence
  Description of Artificial Sequence: Synthetic peptide
  MOD_RES (1)..(7): region may or may not be present
  MOD_RES (11)..(11): neutral or acidic amino acid residue
  MOD_RES (12)..(12): neutral or acidic amino acid residue
  MOD_RES (16)..(16): basic amino acid residue
  MOD_RES (20)..(20): neutral or basic amino acid residue
  MOD_RES (27)..(27): neutral, basic or acidic amino acid residue
  MOD_RES (29)..(29): neutral or acidic amino acid residue
  MOD_RES (30)..(30): neutral or acidic amino acid residue
  MOD_RES (34)..(34): neutral or acidic amino acid residue
  MOD_RES (36)..(36): neutral amino acid residue or not present
  MOD_RES (37)..(37): neutral amino acid residue or not present
  MOD_RES (38)..(38): basic amino acid residue or not present
GVIINVKCKIXXQCLXPCKXAGMRFGXCXXGKCXCXXX

SEQ ID NO: 4914 - DNA, 6587 bp, Artificial Sequence
  Description of Artificial Sequence: Synthetic construct
gtcgtcaacgaccccccattcaagaacagcaagcagcattgagaactttggaatccagtccctcttccacctgctgaccggatcagcagtccccggaacatcgtagctgacgccttcgcgttgctcagttgtccaaccccggaaacgggaaaaagcaagttttccccgctcccggcgtttcaataactgaaaaccatactatttcacagtttaaatcacattaaacgacagtaatccccgttgatttgtgcgccaacacagatcttcgtcacaattctcaagtcgctgatttcaaaaaactgtagtatcctctgcgaaacgatccctgtttgagtattgaggaggcgagatgtcgcagacagaaaatgcagtgacttcctcattgagtcaaaagcggtttgtgcgcagaggtaagcctatgactgactctgagaaacaaatggccgttgttgcaagaaaacgtcttacacacaaagagataaaagtttttgtcaaaaatcctctgaaggatctcatggttgagtactgcgagagagaggggataacacaggctcagttcgttgagaaaatcatcaaagatgaactgcaaagactggatatactaaagtaaagactttactttgtggcgtagcatgctagattactgatcgtttaaggaattttgtggctggccacgccgtaaggtggcaaggaactggttctgatgtggatttacaggagccagaaaagcaaaaaccccgataatcttcttcaacttttgcgagtacgaaaagattaccggggcccacttaaaccgtatagccaacaattcagctatgcggggagtatagttatatgcccggaaaagttcaagacttctttctgtgctcgctccttctgcgcattgtaagtgcaggatggtgtgactgatcttcaccaaacgtattaccgccaggtaaagaacccgaatccggtgtttacaccccgtgaaggtgcaggaacgctgaagttctgcgaaaaactgatggaaaaggcggtgggcttcacttcccgttttgatttcgccattcatgtggcgcacgcccgttcgcgtgatctgcgtcgccgtatgccaccagtgctgcgtcgtcgggctattgatgcgctcttgcaggggctgtgtttccactatgacccgctggccaaccgcgtccagtgctccatcaccacgctggccattgagtgcggactggcgacggagtctgctgccggaaaactctccatcacccgtgccacccgtgccctgacgttcctgtcagagctgggactgattacctaccagacggaatatgacccgcttatcgggtgctacattccgaccgatatcacgttcacatctgcactgtttgctgccctcgatgtatcagaggaggcagtggccgccgcgcgccgcagccgtgtggtatgggaaaacaaacaacgcaaaaagcaggggctggataccctgggcatggatgaactgatagcgaaagcctggcgttttgttcgtgagcgttttcgcagttatcagacagagcttaagtcccgtggaataaagcgtgcccgtgcgcgtcgtgatgcggacagggaacgtcaggatattgtcaccctggtgaaacggcagctgacgcgcgaaatcgcggaagggcgcttcactgccaatcgtgaggcggtaaaacgcgaagttgagcgtcgtgtgaaggagcgcatgattctgtcacgtaaccgtaattacagccggctggccacagcttccccctgaaagtgacctcctctgaataatccggcctgcgccggaggcttccgcacgtctgaagcccgacagcgcacaaaaaatcagcaccacatacaaaaaacaacctcatcatccagcttctggtgcatccggccccccctgttttcgatacaaaacacgcctcacagacggggaattttgcttatccacattaaactgcaagggacttccccataaggttacaaccgttcatgtcataaagcgccatccgccagcgttacagggtgcaatgtatcttttaaacacctgtttatatctcctttaaactacttaattacattcatttaaaaagaaaacctattcactgcctgtccttggacagacagatatgcacctcccaccgcaagcggcgggcccctaccggagccgctttagttacaacactcagacacaaccaccagaaaaaccccggtccagcgcagaactgaaaccacaaagcccctccctcataactgaaaagcggccccgccccggtccgaagggccggaacagagtcgcttttaattatgaatgttgtaactacttcatcatcgctgtcagtcttctcgctggaagttctcagtacacgctcgtaagcggccctgacggcccgctaacgcggagatacgccccgacttcgggtaaaccctcgtcgggaccactccgaccgcgcacagaagctctctcatggctgaaagcgggtatggtctggcagggctggggatgggtaaggtgaaatctatcaatcagtaccggcttacgccgggcttcggcggttttactcctgtttcatatatgaaacaacaggtcaccgccttccatgccgctgatgcggcatatcctggtaacgatatctgaattgttatacatgtgtatatacgtggtaatgacaaaaataggacaagttaaaaatttacaggcgatgcaatgattcaaacacgtaatcaatatcgggggtgggcgaagaactccagcatgagatccccgcgctggaggatcatccagccggcgtcccggaaaacgattccgaagcccaacctttcatagaaggcggcggtggaatcgaaatctcgtgatggcaggttgggcgtcgcttggtcggtcatttcgaaccccagagtcccgctcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgagtcacgacgagatcctcgccgtcgggcatgcgcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcctgcaattcattcaggacaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatctgatcttgatcccctgcgccatcagatccttggcggcaagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgttccgcttcctttagcagcccttgcgccctgagtgcttgcggcagcgtgaagctacatatatgtgatccgggcaaatcgctgaatattccttttgtctccgaccatcaggcacctgagtcgctgtctttttcgtgacattcagttcgctgcgctcacggctctggcagtgaatgggggtaaatggcactacaggcgccttttatggattcatgcaaggaaactacccataatacaagaaaagcccgtcacgggcttctcagggcgttttatggcgggtctgctatgtggtgctatctgactttttgctgttcagcagttcctgccctctgattttccagtctgaccacttcggattatcccgtgacaggtcattcagactggctaatgcacccagtaaggcagcggtatcatcaacaggcttacccgtcttactgtcgaagacgtgcgtaacgtatgcatggtctccccatgcgagagtagggaactgccaggcatcaaataaaacgaaaggctcagtcgaaagactgggcctttcgttttatctgttgtttgtcggtgaacgctctcctgagtaggacaaatccgccgggagcggatttgaacgttgcgaagcaacggcccggagggtggcgggcaggacgcccgccataaactgccaggcatcaaattaagcagaaggccatcctgacggatggcctttttgcgtttctacaaactcttttgtttatttttctaaatacattcaaatatggacgtcgtacttaacttttaaagtatgggcaatcaattgctcctgttaaaattgctttagaaatactttggcagcggtttgttgtattgagtttcatttgcgcattggttaaatggaaagtgaccgtgcgcttactacagcctaatatttttgaaatatcccaagagctttttccttcgcatgcccacgctaaacattctttttctcttttggttaaatcgttgtttgatttattatttgctatatttatttttcgataattatcaactagagaaggaacaattaatggtatgttcatacacgcatgtaaaaataaactatctatatagttgtctttctctgaatgtgcaaaactaagcattccgaagccattattagcagtatgaatagggaaactaaacccagtgataagacctgatgatttcgcttctttaattacatttggagattttttatttacagcattgttttcaaatatattccaattaatcggtgaatgattggagttagaataatctactataggatcatattttattaaattagcgtcatcataatattgcctccattttttagggtaattatccagaattgaaatatcagatttaaccatagaatgaggataaatgatcgcgagtaaataatattcacaatgtaccattttagtcatatcagataagcattgattaatatcattattgcttctacaggctttaattttattaattattctgtaagtgtcgtcggcatttatgtctttcatacccatctctttatccttacctattgtttgtcgcaagttttgcgtgttatatatcattaaaacggtaatagattgacatttgattctaataaattggatttttgtcacactattatatcgcttgaaatacaattgtttaacataagtacctgtaggatcgtacaggtttacgcaagaaaatggtttgttatagtcgattaatcgatttgattctagatttgttttaactaattaaaggaggaataacatatgggcggccatcatcatcatcatcatggcgggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccggcggcggcggcagcggcggcggcggatccggtgttatcatcaacgttaaatgcaaaatctcccgtcagtgcctggaaccgtgcaaaaaagctggtatgcgtttcggtaaatgcatgaacggtaaatgccactgcaccccgaaataatgaattcgagctcactagtgtcgacctgcagggtaccatggaagcttactcgaagatccgcggaaagaagaagaagaagaagaaagcccgaaaggaagctgagttggctgctgccaccgctgagcaataactagcataaccccttggggcctctaaacgggtcttgaggggttttttgctgaaaggaggaaccgctcttcacgctcttcacgcggataaataagtaacgatccggtccagtaatgacctcagaactccatctggatttgttcagaacgctcggttgccgccgggcgttttttattggtgagaatcgcagcaacttgtcgcgccaatcgagccatgtc

SEQ ID NO: 4915 - DNA, 480 bp, Artificial Sequence
  Description of Artificial Sequence: Synthetic construct
atgggcggccatcatcatcatcatcatggcgggggaccgtcagttttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccggcggcggcggcagcggcggcggcggatccggtgttatcatcaacgttaaatgcaaaatctcccgtcagtgcctggaaccgtgcaaaaaagctggtatgcgtttcggtaaatgcatgaacggtaaatgccactgcaccccgaaa

SEQ ID NO: 4916 - protein, 37 aa, Artificial Sequence
  Description of Artificial Sequence: Synthetic peptide
GIINVKCKISAQCLKPCRDAGMRFGKCMNGKCACTPK

SEQ ID NO: 4917 - protein, 160 aa, Artificial Sequence
  Description of Artificial Sequence: Synthetic peptide
MGGHHHHHHGGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISGGGGSGGGGSGVIINVKCKISRQCLEPCKKAGMRFGKCMNGKCHCTPK

SEQ ID NO: 4918 - protein, 4 aa, Artificial Sequence
  Description of Artificial Sequence: Synthetic peptide
GGGG

SEQ ID NO: 4919 - protein, 5 aa, Artificial Sequence
  Description of Artificial Sequence: Synthetic peptide
GGGGG

SEQ ID NO: 4920 - protein, 38 aa, Artificial Sequence
  Description of Artificial Sequence: Synthetic peptide
GVIINVKCKISAQCLKPCKDAGMRFGKCMAGKCACWPK

SEQ ID NO: 4921 - protein, 38 aa, Artificial Sequence
  Description of Artificial Sequence: Synthetic peptide
GVIINVKCKISAQCLKPCKEAGMRFGKCMAGKCACYPK

SEQ ID NO: 4922 - protein, 38 aa, Artificial Sequence; identical to SEQ ID NO: 3258
  Description of Artificial Sequence: Synthetic peptide
  MOD_RES (16)..(16): Orn

SEQ ID NO: 4923 - protein, 38 aa, Artificial Sequence; identical to SEQ ID NO: 3258
  Description of Artificial Sequence: Synthetic peptide
  MOD_RES (16)..(16): hLys

SEQ ID NO: 4924 - protein, 38 aa, Artificial Sequence; identical to SEQ ID NO: 3258
  Description of Artificial Sequence: Synthetic peptide
  MOD_RES (16)..(16): hArg

SEQ ID NO: 4925 - protein, 38 aa, Artificial Sequence; identical to SEQ ID NO: 3258
  Description of Artificial Sequence: Synthetic peptide
  MOD_RES (16)..(16): Cit

SEQ ID NO: 4926 - protein, 38 aa, Artificial Sequence; identical to SEQ ID NO: 3116
  Description of Artificial Sequence: Synthetic peptide
  MOD_RES (16)..(16): hCit

SEQ ID NO: 4927 - protein, 38 aa, Artificial Sequence; identical to SEQ ID NO: 3258
  Description of Artificial Sequence: Synthetic peptide
  MOD_RES (16)..(16): Dpr

SEQ ID NO: 4928 - protein, 38 aa, Artificial Sequence; identical to SEQ ID NO: 3258
  Description of Artificial Sequence: Synthetic peptide
  MOD_RES (16)..(16): Dab

SEQ ID NO: 4929 - protein, 35 aa, Artificial Sequence; identical to SEQ ID NO: 3133
  Description of Artificial Sequence: Synthetic peptide
  MOD_RES (16)..(16): Orn

SEQ ID NO: 4930 - protein, 38 aa, Artificial Sequence
  Description of Artificial Sequence: Synthetic peptide
GVIINVKCKISRQCLEPCKKAGMRFGKCMNGKCGCTPK

SEQ ID NO: 4931 - protein, 38 aa, Artificial Sequence
  Description of Artificial Sequence: Synthetic peptide
GVIINVKCKISRQCLEPCKKAGMRFGKCMNGKCSCTPK

SEQ ID NO: 4932 - protein, 38 aa, Artificial Sequence
  Description of Artificial Sequence: Synthetic peptide
GVIINVKCKISRQCLEPCKKAGMRFGKCMNGKCTCTPK

SEQ ID NO: 4933 - protein, 38 aa, Artificial Sequence
  Description of Artificial Sequence: Synthetic peptide
GVIINVKCKISRQCLEPCKKAGMRFGKCMNGKCNCTPK

SEQ ID NO: 4934 - protein, 38 aa, Artificial Sequence
  Description of Artificial Sequence: Synthetic peptide
GVIINVKCKISRQCLEPCKKAGMRFGKCMNGKCVCTPK

SEQ ID NO: 4935 - protein, 38 aa, Artificial Sequence
  Description of Artificial Sequence: Synthetic peptide
GVIINVKCKISRQCLEPCKKAGMRFGKCMNGKCLCTPK

SEQ ID NO: 4936 - protein, 38 aa, Artificial Sequence
  Description of Artificial Sequence: Synthetic peptide
GVIINVKCKISRQCLEPCKKAGMRFGKCMNGKCICTPK

SEQ ID NO: 4937 - protein, 38 aa, Artificial Sequence
  Description of Artificial Sequence: Synthetic peptide
GVIINVKCKISRQCLEPCKKAGMRFGKCMNGKCPCTPK

SEQ ID NO: 4938 - protein, 38 aa, Artificial Sequence
  Description of Artificial Sequence: Synthetic peptide
GVIINVKCKISRQCLEPCKKAGMRFGKCMNGKCMCTPK

SEQ ID NO: 4939 - protein, 38 aa, Artificial Sequence
  Description of Artificial Sequence: Synthetic peptide
GVIINVKCKISRQCLEPCKKAGMRFGKCMNGKCQCTPK

SEQ ID NO: 4940 - protein, 38 aa, Artificial Sequence
  Description of Artificial Sequence: Synthetic peptide
GVIINVKCKISRQCLEPCKKAGMRFGKCMNGKCKCTPK

SEQ ID NO: 4941 - protein, 38 aa, Artificial Sequence
  Description of Artificial Sequence: Synthetic peptide
GVIINVKCKISRQCLEPCKKAGMRFGKCMNGKCDCTPK

SEQ ID NO: 4942 - protein, 38 aa, Artificial Sequence
  Description of Artificial Sequence: Synthetic peptide
WVIINVKCKISRQCLEPCKKAGMRFGKCMNGKCHCWPK

SEQ ID NO: 4943 - protein, 38 aa, Artificial Sequence
  Description of Artificial Sequence: Synthetic peptide
GVWINVKCKISRQCLEPCKKAGMRFGKCMNGKCHCTPK

SEQ ID NO: 4944 - protein, 38 aa, Artificial Sequence
  Description of Artificial Sequence: Synthetic peptide
GVIIWVKCKISRQCLEPCKKAGMRFGKCMNGKCHCTPK

SEQ ID NO: 4945 - protein, 38 aa, Artificial Sequence
  Description of Artificial Sequence: Synthetic peptide
  MOD_RES (1)..(1): 1Nal
XVIINVKCKISRQCLEPCKKAGMRFGKCMNGKCHCWPK

SEQ ID NO: 4946 - protein, 38 aa, Artificial Sequence; identical to SEQ ID NO: 1495
  Description of Artificial Sequence: Synthetic peptide
  MOD_RES (3)..(3): 1Nal

SEQ ID NO: 4947 - protein, 38 aa, Artificial Sequence; identical to SEQ ID NO: 1497
  Description of Artificial Sequence: Synthetic peptide
  MOD_RES (5)..(5): 1Nal

SEQ ID NO: 4948 - protein, 38 aa, Artificial Sequence
  Description of Artificial Sequence: Synthetic peptide
GVIKNVKCKISRQCLEPCKKAGMRFGKCMNGKCHCTPK

SEQ ID NO: 4949 - protein, 38 aa, Artificial Sequence
  Description of Artificial Sequence: Synthetic peptide
GVIKNVKCKISRQCLEPCKKAGMRFGKCMNGKCACTPK

SEQ ID NO: 4950 - protein, 38 aa, Artificial Sequence
  Description of Artificial Sequence: Synthetic peptide
  MOD_RES (1)..(1): 1Nal
XVIINVKCKISRQCLEPCKKAGMRFGKCMNGKCACWPK

SEQ ID NO: 4951 - protein, 38 aa, Artificial Sequence
  Description of Artificial Sequence: Synthetic peptide
  MOD_RES (3)..(3): 1Nal
GVXINVKCKISRQCLEPCKKAGMRFGKCMNGKCACTPK

SEQ ID NO: 4952 - protein, 38 aa, Artificial Sequence
  Description of Artificial Sequence: Synthetic peptide
  MOD_RES (5)..(5): 1Nal
GVIIXVKCKISRQCLEPCKKAGMRFGKCMNGKCACTPK

SEQ ID NO: 4953 - protein, 38 aa, Artificial Sequence
  Description of Artificial Sequence: Synthetic peptide
WVIINVKCKISRQCLEPCKKAGMRFGKCMNGKCACWPK

SEQ ID NO: 4954 - protein, 38 aa, Artificial Sequence
  Description of Artificial Sequence: Synthetic peptide
GVWINVKCKISRQCLEPCKKAGMRFGKCMNGKCACTPK

SEQ ID NO: 4955 - protein, 38 aa, Artificial Sequence
  Description of Artificial Sequence: Synthetic peptide
GVIIWVKCKISRQCLEPCKKAGMRFGKCMNGKCACTPK

SEQ ID NO: 4956 - protein, 38 aa, Artificial Sequence
  Description of Artificial Sequence: Synthetic peptide
WVWIWVKCKISRQCLEPCKKAGMRFGKCMNGKCACTPK

SEQ ID NO: 4957 - protein, 38 aa, Artificial Sequence
  Description of Artificial Sequence: Synthetic peptide
  MOD_RES (1)..(1): 1Nal
  MOD_RES (3)..(3): 1Nal
  MOD_RES (5)..(5): 1Nal
XVXIXVKCKISRQCLEPCKKAGMRFGKCMNGKCACTPK

SEQ ID NO: 4958 - protein, 31 aa, Artificial Sequence
  Description of Artificial Sequence: Synthetic peptide
CKISRQCLEPCKKAGMRFGKCMNGKCACTPK

SEQ ID NO: 4959 - protein, 32 aa, Artificial Sequence
  Description of Artificial Sequence: Synthetic peptide
KCKISRQCLEPCKKAGMRFGKCMNGKCACTPK

SEQ ID NO: 4960 - protein, 38 aa, Artificial Sequence
  Description of Artificial Sequence: Synthetic peptide
  MOD_RES (11)..(11): 1Nal
GVIINVKCKIXRQCLEPCKKAGMRFGKCANGKCACWPK

SEQ ID NO: 4961 - protein, 38 aa, Artificial Sequence
  Description of Artificial Sequence: Synthetic peptide
GVIINVKCKIRRQCLEPCKKAGMRFGKCANGKCACWPK

SEQ ID NO: 4962 - protein, 38 aa, Artificial Sequence
  Description of Artificial Sequence: Synthetic peptide
GVIINVKCKISRQCEEPCKKAGMRFGKCANGKCACWPK

SEQ ID NO: 4963 - protein, 38 aa, Artificial Sequence
  Description of Artificial Sequence: Synthetic peptide
GVIINVKCKIRRQCLEPCKKAGMRFGKCMNGKCACWPK

SEQ ID NO: 4964 - protein, 38 aa, Artificial Sequence
  Description of Artificial Sequence: Synthetic peptide
GVIINVKCKISRQCEEPCKKAGMRFGKCMNGKCACWPK

SEQ ID NO: 4965 - protein, 31 aa, Artificial Sequence
  Description of Artificial Sequence: Synthetic peptide
CKIRRQCEEPCKKAGMRFGKCANGKCACTPK

SEQ ID NO: 4966 - protein, 38 aa, Artificial Sequence
  Description of Artificial Sequence: Synthetic peptide
GVIINVKCKIRRQCEEPCKKAGMRFGKCANGKCACTPK

SEQ ID NO: 4967 - protein, 38 aa, Artificial Sequence
  Description of Artificial Sequence: Synthetic peptide
CVIINVKCKIRRQCEEPCKKAGMRFGKCANGKCACTCK

SEQ ID NO: 4968 - protein, 38 aa, Artificial Sequence
  Description of Artificial Sequence: Synthetic peptide
GVIINVKCKIRAQCEEPCKKAGMRFGKCANGKCACTPK

SEQ ID NO: 4969 - protein, 38 aa, Artificial Sequence; identical to SEQ ID NO: 4968
  Description of Artificial Sequence: Synthetic peptide
  c-term amidation

SEQ ID NO: 4970 - protein, 38 aa, Artificial Sequence; identical to SEQ ID NO: 4968
  Description of Artificial Sequence: Synthetic peptide
  n-term acetylation
  c-term amidation

SEQ ID NO: 4971 - protein, 38 aa, Artificial Sequence
  Description of Artificial Sequence: Synthetic peptide
  MOD_RES (11)..(11): 1Nal
GVIINVKCKIXAQCEEPCKKAGMRFGKCANGKCACTPK

SEQ ID NO: 4972 - protein, 38 aa, Artificial Sequence
  Description of Artificial Sequence: Synthetic peptide
  MOD_RES (34)..(34): 1Nal
GVIINVKCKISRQCLEPCKKAGMRFGKCANGKCXCWPK

SEQ ID NO: 4973 - protein, 38 aa, Artificial Sequence; identical to SEQ ID NO: 1392
  Description of Artificial Sequence: Synthetic peptide

SEQ ID NO: 4974 - protein, 38 aa, Artificial Sequence
  Description of Artificial Sequence: Synthetic peptide
GVIINVKCKISAQCLKPCKDAGMRFGKCMNGKCACTPK

SEQ ID NO: 4975 - protein, 38 aa, Artificial Sequence
  Description of Artificial Sequence: Synthetic peptide
GVIINVKCKISAQCLKPCKDAGMRFGKCANGKCACTPK

SEQ ID NO: 4976 - protein, 38 aa, Artificial Sequence
  Description of Artificial Sequence: Synthetic peptide
GVIINVKCKIRAQCLKPCKDAGMRFGKCANGKCACTPK

SEQ ID NO: 4977 - protein, 38 aa, Artificial Sequence
  Description of Artificial Sequence: Synthetic peptide
GVIINVKCKISAQCEKPCKDAGMRFGKCANGKCACTPK

SEQ ID NO: 4978 - protein, 38 aa, Artificial Sequence
  Description of Artificial Sequence: Synthetic peptide
  MOD_RES (11)..(11): 1Nal
GVIINVKCKIXAQCLKPCKDAGMRFGKCANGKCACTPK

SEQ ID NO: 4979 - protein, 38 aa, Artificial Sequence
  Description of Artificial Sequence: Synthetic peptide
GVIINVKCKIRAQCEKPCKDAGMRFGKCANGKCACTPK

SEQ ID NO: 4980 - protein, 38 aa, Artificial Sequence
  Description of Artificial Sequence: Synthetic peptide
GVIINVKCKIRAQCEKPCKDAGMRFGKCMNGKCACTPK

SEQ ID NO: 4981 - protein, 38 aa, Artificial Sequence
  Description of Artificial Sequence: Synthetic peptide
  MOD_RES (34)..(34): 1Nal
GVIINVKCKISAQCLKPCKDAGMRFGKCMNGKCXCTPK

SEQ ID NO: 4982 - protein, 38 aa, Artificial Sequence; identical to SEQ ID NO: 4974
  Description of Artificial Sequence: Synthetic peptide

SEQ ID NO: 4983 - protein, 38 aa, Artificial Sequence
  Description of Artificial Sequence: Synthetic peptide
  MOD_RES (34)..(34): 1Nal
GVIINVKCKISAQCLKPCKDAGMRFGKCANGKCXCTPK

SEQ ID NO: 4984 - protein, 38 aa, Artificial Sequence; identical to SEQ ID NO: 4975
  Description of Artificial Sequence: Synthetic peptide

SEQ ID NO: 4985 - protein, 38 aa, Artificial Sequence
  Description of Artificial Sequence: Synthetic peptide
  n-term acetylation
  MOD_RES (19)..(19): Lys(Glycyl)
GVIINVKCKISRQCLEPCXKAGMRFGKCMNGKCACTPK

SEQ ID NO: 4986 - protein, 38 aa, Artificial Sequence
  Description of Artificial Sequence: Synthetic peptide
  n-term acetylation
  MOD_RES (4)..(4): Lys(Glycyl)
GVIXNVKCKISRQCLEPCKKAGMRFGKCMNGKCACTPK

SEQ ID NO: 4987 - protein, 38 aa, Artificial Sequence
  Description of Artificial Sequence: Synthetic peptide
  n-term acetylation
  MOD_RES (38)..(38): Lys(Glycyl)
GVIINVKCKISRQCLEPCKKAGMRFGKCMNGKCACTPX

SEQ ID NO: 4988 - protein, 38 aa, Artificial Sequence
  Description of Artificial Sequence: Synthetic peptide
  MOD_RES (34)..(34): 1Nal
GVIINVKCKISRQCLEPCKKAGMRFGKCANGKCXCTPK

SEQ ID NO: 4989 - protein, 28 aa, Artificial Sequence
  Description of Artificial Sequence: Synthetic peptide
  c-term amidation
CKISRQCLKPCKDAGMRFGKCMNGKCHC

SEQ ID NO: 4990 - protein, 38 aa, Artificial Sequence
  Description of Artificial Sequence: Synthetic peptide
GVIINVKCKISRQCLKPCKDAGMRFGKCMNGKCACTPK

SEQ ID NO: 4991 - protein, 38 aa, Artificial Sequence
  Description of Artificial Sequence: Synthetic peptide
  MOD_RES (11)..(11): 1Nal
  MOD_RES (34)..(34): 1Nal
GVIINVKCKIXAQCLEPCKKAGMRFGKCANGKCXCTPK

SEQ ID NO: 4992 - protein, 38 aa, Artificial Sequence
  Description of Artificial Sequence: Synthetic peptide
  MOD_RES (11)..(11): 1Nal
  MOD_RES (34)..(34): 1Nal
GVIINVKCKIXAQCLEPCKKAGMRFGKCANGKCXCTEK

SEQ ID NO: 4993 - protein, 38 aa, Artificial Sequence
  Description of Artificial Sequence: Synthetic peptide
  MOD_RES (11)..(11): 1Nal
  MOD_RES (34)..(34): 1Nal
GVIINVKCKIXAQCEEPCKKAGMRFGKCANGKCXCEEK

SEQ ID NO: 4994 - protein, 38 aa, Artificial Sequence
  Description of Artificial Sequence: Synthetic peptide
  MOD_RES (11)..(11): 1Nal
  MOD_RES (34)..(34): 1Nal
GVIINVKCKIXAQCLEPCKKAGFRFGKCANGKCXCTPK

SEQ ID NO: 4995 - protein, 38 aa, Artificial Sequence
  Description of Artificial Sequence: Synthetic peptide
  MOD_RES (11)..(11): 1Nal
  MOD_RES (23)..(23): Nle
  MOD_RES (34)..(34): 1Nal
GVIINVKCKIXAQCLEPCKKAGXRFGKCANGKCXCTEK

SEQ ID NO: 4996 - protein, 38 aa, Artificial Sequence
  Description of Artificial Sequence: Synthetic peptide
  MOD_RES (38)..(38): Nle
GVIINVKCKISPQCLKPCKDAGMRFGKCMNGKCACTYX

SEQ ID NO: 4997 - protein, 38 aa, Artificial Sequence
  Description of Artificial Sequence: Synthetic peptide
  MOD_RES (16)..(16): Orn
  MOD_RES (38)..(38): Nle
GVIINVKCKISPQCLXPCKEAGMRFGKCMNGKCACTYX

SEQ ID NO: 4998 - protein, 34 aa, Artificial Sequence
  Description of Artificial Sequence: Synthetic peptide
  MOD_RES (30)..(30): 1Nal
NVKCKISRQCLEPCKKAGMRFGKCANGKCXCTPK

SEQ ID NO: 4999 - protein, 34 aa, Artificial Sequence
  Description of Artificial Sequence: Synthetic peptide
NVKCKISRQCLEPCKKAGMRFGKCANGKCACTPK

SEQ ID NO: 5000 - protein, 38 aa, Artificial Sequence
  Description of Artificial Sequence: Synthetic peptide
GVIINVKCKIRRQCLEPCKKAGMRFGKCANGKCACTPK

SEQ ID NO: 5001 - protein, 38 aa, Artificial Sequence
  Description of Artificial Sequence: Synthetic peptide
GVIINVKCKIRAQCLEPCKKAGMRFGKCANGKCACTPK

SEQ ID NO: 5002 - protein, 31 aa, Artificial Sequence; identical to SEQ ID NO: 4958
  Description of Artificial Sequence: Synthetic peptide

SEQ ID NO: 5003 - protein, 28 aa, Artificial Sequence
  Description of Artificial Sequence: Synthetic peptide
CKISRQCLEPCKKAGMRFGKCMNGKCAC

SEQ ID NO: 5004 - protein, 28 aa, Artificial Sequence
  Description of Artificial Sequence: Synthetic peptide
CKIRRQCLEPCKKAGMRFGKCANGKCAC

SEQ ID NO: 5005 - protein, 28 aa, Artificial Sequence
  Description of Artificial Sequence: Synthetic peptide
CKISAQCLEPCKKAGMRFGKCANGKCAC

SEQ ID NO: 5006 - protein, 28 aa, Artificial Sequence
  Description of Artificial Sequence: Synthetic peptide
CKISAQCLEPCKKAGMRFGKCMNGKCAC

SEQ ID NO: 5007 - DNA, 1695 bp, Artificial Sequence
  Description of Artificial Sequence: Synthetic construct
  CDS (1)..(1692)
atggaatggagctgggtctttctcttcttcctgtcagtaacgactggtgtccactccgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaacgaggcaagagggctgtggggggcggtgggagcggcggcgggggctcaggtggcgggggaagtggcgggggagggagtggagggggagggagtggaggcgggggatccggcggggggggtagcaagcgtcgcgagaagcgggataagacccatacctgccccccctgtcccgcgcccgagttgctcgggggccccagcgtgtttttgtttcctcccaagcctaaagatacattgatgattagtagaacacccgaagtgacctgtgtcgtcgtcgatgtctctcatgaggatcccgaagtgaaattcaattggtatgtcgatggggtcgaagtccacaacgctaaaaccaaacccagagaagaacagtataattctacctatagggtcgtgtctgtgttgacagtgctccatcaagattggctcaacgggaaagaatacaaatgtaaagtgagtaataaggctttgcccgctcctattgaaaagacaattagtaaggctaagggccaacctagggagccccaagtctatacactccctcccagtagagacgagctgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaaggaggaggaggatccggaggaggaggaagcagctgcatcgacaccatccccaagagccgctgcaccgccttccagtgcaagcacagcatgaagtaccgcctgagcttctgccgcaagacctgcggcacctgctaa

SEQ ID NO: 5008 - protein, 564 aa, Artificial Sequence
  Description of Artificial Sequence: Synthetic polypeptide
MEWSWVFLFFLSVTTGVHSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKRGKRAVGGGGSGGGGSGGGGSGGGGSGGGGSGGGGSGGGGSKRREKRDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSSCIDTIPKSRCTAFQCKHSMKYRLSFCRKTCGTC

SEQ ID NO: 5009 - protein, 38 aa, Artificial Sequence; identical to SEQ ID NO: 1496
  Description of Artificial Sequence: Synthetic peptide
  MOD_RES (4)..(4): Dpr(AOA)

SEQ ID NO: 5010 - protein, 38 aa, Artificial Sequence; identical to SEQ ID NO: 1496
  Description of Artificial Sequence: Synthetic peptide
  MOD_RES (4)..(4): Dpr(AOA-PEG)

SEQ ID NO: 5011 - protein, 38 aa, Artificial Sequence
  Description of Artificial Sequence: Synthetic peptide
  MOD_RES (1)..(7): amino acid residues 1 to 7 are optional
  MOD_RES (11)..(11): neutral, basic or acidic amino acid residue
  MOD_RES (12)..(12): neutral or acidic amino acid residue
  MOD_RES (15)..(15): neutral or acidic amino acid residue
  MOD_RES (16)..(16): neutral or basic amino acid residue
  MOD_RES (19)..(19): neutral or basic amino acid residue
  MOD_RES (20)..(20): neutral, basic or acidic amino acid residue
  MOD_RES (27)..(27): neutral, basic or acidic amino acid residue
  MOD_RES (29)..(29): neutral or acidic amino acid residue
  MOD_RES (30)..(30): neutral or acidic amino acid residue
  MOD_RES (32)..(32): neutral, basic or acidic amino acid residue
  MOD_RES (34)..(34): neutral or acidic amino acid residue
  MOD_RES (36)..(36): neutral amino acid residue or not present
  MOD_RES (37)..(37): neutral amino acid residue or not present
  MOD_RES (38)..(38): basic amino acid residue or not present
GVIINVKCKIXXQCXXPCXXAGMRFGXCXXGXCXCXXX

SEQ ID NO: 5012 - protein, 38 aa, Artificial Sequence
  Description of Artificial Sequence: Synthetic peptide
GCIINVKCKISRQCLEPCKKAGMRFGKCMNGKCHCTCK

SEQ ID NO: 5013 - protein, 38 aa, Artificial Sequence
  Description of Artificial Sequence: Synthetic peptide
SCIINVKCKISRQCLEPCKKAGMRFGKCMNGKCHCTCK

SEQ ID NO: 5014 - protein, 38 aa, Artificial Sequence
  Description of Artificial Sequence: Synthetic peptide
SCIINVKCKISRQCLEPCKKAGMRFGKCMNGKCACTCK

SEQ ID NO: 5015 - protein, 39 aa, Artificial Sequence
  Description of Artificial Sequence: Synthetic peptide
SCVIINVKCKISRQCLEPCKKAGMRFGKCMNGKCHCTCK

What is claimed is:

1. An OSK1 peptide analog comprising the amino acid sequence of SEQ ID NO: 4916, or a pharmaceutically acceptable salt of the OSK1 peptide analog.

2. The OSK1 peptide analog of claim 1, wherein the C-terminal carboxylic acid moiety is replaced with a moiety selected from (A) —COOR, where R is independently ($C_1$-$C_8$)alkyl, haloalkyl, aryl or heteroaryl;

(B) —C(═O)NRR, where R is independently hydrogen, ($C_1$-$C_8$)alkyl, haloalkyl, aryl or heteroaryl; and (C) —$CH_2$OR where R is hydrogen, ($C_1$-$C_8$)alkyl, aryl or heteroaryl.

3. A pharmaceutical composition, comprising the OSK1 peptide analog of claim 1, or a pharmaceutically acceptable salt thereof; and a pharmaceutically acceptable carrier.

* * * * *